(12) United States Patent
Frost et al.

(10) Patent No.: US 10,328,130 B2
(45) Date of Patent: Jun. 25, 2019

(54) MODIFIED HYALURONIDASES AND USES IN TREATING HYALURONAN-ASSOCIATED DISEASES AND CONDITIONS

(75) Inventors: Gregory I. Frost, Del Mar, CA (US); Ping Jiang, San Diego, CA (US); Curtis B. Thompson, Encinitas, CA (US)

(73) Assignee: Halozyme, Inc., San Diego, CA (US)

( * ) Notice: Subject to any disclaimer, the term of this patent is extended or adjusted under 35 U.S.C. 154(b) by 0 days.

(21) Appl. No.: 13/385,528

(22) Filed: Feb. 22, 2012

(65) Prior Publication Data

US 2012/0171153 A1 Jul. 5, 2012
US 2013/0028856 A9 Jan. 31, 2013

Related U.S. Application Data

(63) Continuation of application No. 12/386,222, filed on Apr. 14, 2009, now abandoned.

(60) Provisional application No. 61/195,624, filed on Oct. 8, 2008, provisional application No. 61/130,357, filed on May 29, 2008, provisional application No. 61/124,278, filed on Apr. 14, 2008.

(51) Int. Cl.
| | |
|---|---|
| *C12N 9/26* | (2006.01) |
| *A61K 38/47* | (2006.01) |
| *C12N 11/08* | (2006.01) |
| *A61K 31/337* | (2006.01) |

(52) U.S. Cl.
CPC ............ *A61K 38/47* (2013.01); *A61K 31/337* (2013.01); *C12N 9/2408* (2013.01); *C12N 11/08* (2013.01)

(58) Field of Classification Search
CPC ...... C12N 9/14; G01N 33/564; G01N 33/573; C12Q 1/6827; C12Q 1/34; C07K 14/005; A61K 38/00
USPC ...................... 435/6.12, 7.92, 7.4, 7.1, 18, 5
See application file for complete search history.

(56) References Cited

U.S. PATENT DOCUMENTS

| | | | |
|---|---|---|---|
| 3,536,809 A | 10/1970 | Applezweig | 424/28 |
| 3,598,123 A | 8/1971 | Zaffaroni | 424/435 |
| 3,630,200 A | 12/1971 | Higuchi | 424/427 |
| 3,710,795 A | 1/1973 | Higuchi et al. | 424/424 |
| 3,845,770 A | 11/1974 | Theeuwes et al. | 424/427 |
| 3,916,899 A | 11/1975 | Theeuwes et al. | 424/424 |
| 4,002,531 A | 1/1977 | Royer | 435/188 |
| 4,008,719 A | 2/1977 | Theeuwes et al. | 424/427 |
| 4,044,126 A | 8/1977 | Cook et al. | 514/180 |
| 4,179,337 A | 12/1979 | Davis et al. | 435/181 |
| 4,364,923 A | 12/1982 | Cook et al. | 424/46 |
| 4,414,209 A | 11/1983 | Cook et al. | 514/180 |
| 4,769,027 A | 9/1988 | Baker et al. | 424/493 |
| 4,952,496 A | 8/1990 | Studier et al. | 435/91.41 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,120,548 A | 6/1992 | McClelland et al. | 424/473 |
| 5,122,614 A | 6/1992 | Zalipsky | 548/520 |
| 5,292,509 A | 3/1994 | Hageman | 424/94.61 |
| 5,323,907 A | 6/1994 | Kalvelage | 206/531 |
| 5,324,844 A | 6/1994 | Zalipsky | 548/520 |
| 5,446,090 A | 8/1995 | Harris | 525/54.1 |
| 5,591,767 A | 1/1997 | Mohr et al. | 514/413 |
| 5,612,460 A | 3/1997 | Zalipsky | 530/391.9 |
| 5,639,476 A | 6/1997 | Oshlack et al. | 424/468 |
| 5,643,575 A | 7/1997 | Martinez et al. | 424/194.1 |
| 5,665,069 A | 9/1997 | Cumer et al. | 604/116 |
| 5,672,662 A | 9/1997 | Harris et al. | 525/408 |
| 5,674,533 A | 10/1997 | Santus et al. | 424/493 |
| 5,721,348 A | 2/1998 | Primakoff | 536/22.1 |
| 5,733,566 A | 3/1998 | Lewis | 424/426 |
| 5,747,027 A | 5/1998 | Stern et al. | 424/94.62 |
| 5,766,581 A | 6/1998 | Bartley et al. | 424/85.1 |
| 5,795,569 A | 8/1998 | Bartley et al. | 424/85.1 |
| 5,808,096 A | 9/1998 | Zalipsky | 548/520 |
| 5,827,721 A | 10/1998 | stern et al. | 435/201 |

(Continued)

FOREIGN PATENT DOCUMENTS

| | | |
|---|---|---|
| EP | 0822199 | 9/2004 |
| EP | 1064951 | 8/2007 |

(Continued)

OTHER PUBLICATIONS

Goertz DE et al. High-frequency Doppler Ultrasound Monitors the Effects of Antivascular Therapy on Tumor Blood Flow. 2002. Cancer Research. 62: 6371-6375.*

(Continued)

*Primary Examiner* — Paul J Holland

(74) *Attorney, Agent, or Firm* — Dentons US LLP; Stephanie Seidman

(57) ABSTRACT

Provided are combinations, compositions and kits containing a hyaluronan degrading enzyme, such as a soluble hyaluronidase, for treatment of hyaluronan-associated conditions, diseases and disorders. In one example, the products include an additional agent or treatment. Such products can be used in methods for administering the products to treat the hyaluronan-associated diseases and conditions, for example, hyaluronan-associated cancers, for example, hyaluronan-rich tumors. The methods include administration of the hyaluronan degrading enzyme composition alone or in combination with other treatments. Also provided are methods and compositions for providing sustained treatment effects in hyaluronan-associated diseases and conditions.

31 Claims, 17 Drawing Sheets

Specification includes a Sequence Listing.

(56) References Cited

U.S. PATENT DOCUMENTS

| | | | |
|---|---|---|---|
| 5,854,046 A | 12/1998 | Au-Young et al. | 435/201 |
| 5,900,461 A | 5/1999 | Harris | 525/54.11 |
| 5,919,455 A | 7/1999 | Greennnwald et al. | 525/54.11 |
| 5,932,462 A | 8/1999 | Harris et al. | 424/178.1 |
| 5,958,750 A | 9/1999 | Au-Young et al. | 435/201 |
| 5,976,556 A | 11/1999 | Norton et al. | 424/401 |
| 5,985,263 A | 11/1999 | Lee et al. | 424/85.2 |
| 5,990,237 A | 11/1999 | Bentley et al. | 525/54.2 |
| 6,054,569 A | 4/2000 | Benett et al. | 536/23.2 |
| 6,057,110 A | 5/2000 | Au-Young et al. | 435/6 |
| 6,113,906 A | 9/2000 | Greenwald et al. | 424/194.1 |
| 6,123,938 A | 9/2000 | Stern et al. | 424/94.62 |
| 6,193,963 B1 | 2/2001 | Stern et al. | 424/94.6 |
| 6,214,966 B1 | 4/2001 | Harris | 528/322 |
| 6,258,351 B1 | 7/2001 | Harris | 424/78.3 |
| 6,340,742 B1 | 1/2002 | Burg et al. | 530/351 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,552,170 B1 | 4/2003 | Thompson et al. | 530/351 |
| 6,737,505 B2 | 5/2004 | Bentley et al. | 528/425 |
| 6,745,776 B2 | 6/2004 | Soll | 430/336 |
| 6,828,401 B2 | 12/2004 | Nho et al. | 526/333 |
| 6,828,431 B1 | 12/2004 | Frudakis et al. | 536/23.1 |
| 6,858,736 B2 | 2/2005 | Nho et al. | 546/290 |
| 7,105,330 B2 | 9/2006 | Stern et al. | 435/200 |
| 7,148,201 B2 | 12/2006 | Stern et al. | 514/44 R |
| 7,261,889 B2 | 8/2007 | Weber et al. | 424/94.62 |
| 7,368,108 B2 | 5/2008 | DeFrees et al. | 424/94.5 |
| 7,544,499 B2 | 6/2009 | Frost et al. | 435/200 |
| 7,718,428 B2 | 5/2010 | Frost et al. | 514/2 |
| 7,767,429 B2 | 8/2010 | Frost et al. | 435/201 |
| 7,781,397 B2 | 8/2010 | Stern et al. | 424/94.62 |
| 7,829,081 B2 | 8/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 8,105,586 B2 | 1/2012 | Bookbinder et al. | 424/94.3 |
| 8,187,855 B2 | 5/2012 | Baker et al. | 435/201 |
| 8,202,517 B2 | 6/2012 | Bookbinder et al. | 424/94.62 |
| 8,257,699 B2 | 9/2012 | Bookbinder et al. | 424/94.62 |
| 8,318,154 B2 | 11/2012 | Frost et al. | 424/94.5 |
| 8,343,487 B2 | 1/2013 | Baker et al. | 424/94.62 |
| 8,431,124 B2 * | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,580,252 B2 | 11/2013 | Bookbinder et al. | 424/85.2 |
| 8,765,685 B2 | 7/2014 | Bookbinder et al. | 514/20.9 |
| 8,772,246 B2 | 7/2014 | Bookbinder et al. | 435/200 |
| 8,846,034 B2 | 9/2014 | Jiang et al. | 424/94.62 |
| 8,927,249 B2 | 1/2015 | Wei et al. | 424/450 |
| 9,084,743 B2 | 7/2015 | Teschner et al. | 514/183 |
| 9,284,543 B2 | 3/2016 | Wei et al. | 435/201 |
| 9,333,244 B2 | 5/2016 | Li et al. | 424/94.62 |
| 9,447,401 B2 | 9/2016 | Wei et al. | 424/94.62 |
| 9,878,046 B2 | 1/2018 | Shepard et al. | 424/130.1 |
| 9,913,822 B2 | 3/2018 | Maneval et al. | 435/195 |
| 10,016,491 B2 | 7/2018 | Bookbinder et al. | 424/94.62 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0170243 A1 | 9/2003 | Stern et al. | 514/44 |
| 2003/0212021 A1 | 11/2003 | Frost et al. | 514/44 R |
| 2003/0220447 A1 | 11/2003 | Harris | 528/322 |
| 2004/0013637 A1 | 1/2004 | Bentley et al. | 424/78.17 |
| 2004/0096921 A1 | 5/2004 | Stern et al. | 435/6 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.62 |
| 2005/0287134 A1 | 12/2005 | Klein | 424/94.61 |
| 2006/0104968 A1 | 5/2006 | Bookbinder et al. | 424/94.61 |
| 2006/0247201 A1 | 11/2006 | Frost et al. | 514/44 R |
| 2007/0134228 A1 | 6/2007 | Stern et al. | 514/2 |
| 2007/0148156 A1 | 6/2007 | Frost et al. | 435/200 |
| 2009/0123367 A1 | 5/2009 | Bookbinder et al. | 424/1.49 |
| 2009/0181013 A1 | 7/2009 | Bookbinder et al. | 424/130.1 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2009/0304665 A1 | 12/2009 | Frost et al. | 424/94.5 |
| 2009/0311237 A1 | 12/2009 | Frost et al. | 424/94.62 |
| 2010/0003237 A1 | 1/2010 | Keller et al. | 424/94.62 |
| 2010/0003238 A1 | 1/2010 | Frost et al. | 424/94.62 |
| 2010/0074885 A1 | 3/2010 | Schiff et al. | 424/130.1 |
| 2010/0143457 A1 | 6/2010 | Wei et al. | 424/450 |
| 2010/0172892 A1 | 7/2010 | Uvarkina et al. | 424/94.62 |
| 2010/0184845 A1 | 7/2010 | Frost et al. | 514/44 R |
| 2010/0211015 A1 | 8/2010 | Bookbinder et al. | 604/187 |
| 2010/0196423 A1 | 11/2010 | Bookbinder et al. | 424/247.1 |
| 2011/0008309 A1 | 1/2011 | Bookbinder et al. | 424/94.3 |
| 2011/0053247 A1 | 3/2011 | Baker et al. | 435/201 |
| 2011/0152359 A1 | 6/2011 | Bookbinder et al. | 435/200 |
| 2012/0020951 A1 | 1/2012 | Shepard et al. | 424/130.1 |
| 2012/0093770 A1 | 4/2012 | Bookbinder et al. | 424/94.62 |
| 2012/0148555 A1 | 6/2012 | Bookbinder et al. | 435/200 |
| 2012/0196348 A1 | 8/2012 | Baker et al. | 424/94.62 |
| 2012/0213767 A1 | 8/2012 | Wei et al. | 424/450 |
| 2012/0251517 A1 | 10/2012 | Frost et al. | 424/94.62 |
| 2012/0251620 A1 | 10/2012 | Bookbinder et al. | 424/450 |
| 2012/0294830 A1 | 11/2012 | Bookbinder et al. | 424/85.2 |
| 2013/0011378 A1 | 1/2013 | Yang et al. | 424/94.3 |
| 2013/0022588 A1 | 1/2013 | Yang et al. | 424/94.3 |
| 2013/0022592 A1 | 1/2013 | Vaughn et al. | 424/94.62 |
| 2013/0058893 A1 | 3/2013 | Bookbinder et al. | 435/200 |
| 2013/0202583 A1 | 8/2013 | Jiang et al. | 424/94.62 |
| 2013/0251786 A1 | 9/2013 | Li et al. | 424/94.62 |
| 2013/0302275 A1 | 11/2013 | Wei et al. | 424/94.62 |
| 2013/0302400 A1 | 11/2013 | Maneval et al. | 435/195 |
| 2014/0199282 A1 | 7/2014 | Bookbinder et al. | 435/200 |
| 2014/0248237 A1 | 9/2014 | Bookbinder et al. | 424/94.62 |
| 2014/0348817 A1 | 11/2014 | Jiang et al. | 424/94.62 |
| 2015/0196623 A9 | 7/2015 | Bookbinder et al. | 424/94.62 |
| 2015/0218511 A1 | 8/2015 | Jiang et al. | 424/94.62 |
| 2016/0220690 A1 | 8/2016 | Shepard et al. | 424/94.62 |
| 2017/0218069 A1 | 8/2017 | Rosengren et al. | 424/133.1 |
| 2017/0290796 A1 | 10/2017 | Maneval et al. | 435/195 |
| 2018/0044419 A9 | 2/2018 | Rosengren et al. | 424/133.1 |
| 2018/0185506 A1 | 7/2018 | Bookbinder et al. | 424/94.62 |

FOREIGN PATENT DOCUMENTS

| | | |
|---|---|---|
| JP | 6-503721 | 4/1994 |
| JP | 2001-508646 A | 7/2001 |
| JP | 2006-524507 A | 11/2006 |
| WO | WO 1988/02261 | 4/1988 |
| WO | WO 1994/28024 | 12/1994 |
| WO | WO 1998/016655 | 4/1998 |
| WO | WO 1998/052602 | 11/1998 |
| WO | WO 1999/002181 | 1/1999 |
| WO | WO 2000/02017 | 1/2000 |
| WO | WO 2001/87925 | 4/2001 |
| WO | WO 2001/076640 | 10/2001 |
| WO | WO 2002/49673 | 6/2002 |
| WO | WO 2004/058147 | 7/2004 |
| WO | WO 2004/078140 | 9/2004 |
| WO | WO 2005/035548 | 4/2005 |
| WO | WO 2006/091871 | 8/2006 |
| WO | WO 2007/047242 | 4/2007 |

(56) References Cited

FOREIGN PATENT DOCUMENTS

| WO | WO 2009/128917 | 10/2009 |
|----|----------------|---------|
| WO | WO 2012/136768 | 11/2012 |

OTHER PUBLICATIONS

Paiva P et al. Expression patterns of hyaluronan, hyaluronan synthases and hyaluronidases indicate a role for hyaluronan in the progression of endometrial cancer. 2005. Gynecologic Oncology. 98:193-202.*
Pritzker KPH. Cancer Biomarkers: Easier Said Than Done. 2002. Clinical Chemistry. 48:8 pp. 1147-1150.*
Udabage L et al. The over-expression of HAS2, Hyal-2 and CD44 is implicated in the invasiveness of breast cancer. 2005. Experimental Cell Research. 310:205-217.*
U.S. Appl. No. 11/238,171, filed Sep. 27, 2005, 2006-0104968, May 18, 2006.
U.S. Appl. No. 12/378,969, filed Feb. 20, 2009, 2009-0181013, Jul. 16, 2009.
U.S. Appl. No. 12/378,984, filed Feb. 20, 2009, 2009-0181032, Jul. 16, 2009.
U.S. Appl. No. 12/381,844, filed Mar. 6, 2009, 2010-0074885, Mar. 25, 2010.
U.S. Appl. No. 12/386,222, filed Apr. 14, 2009, 2010-0003238, Jan. 7, 2010.
U.S. Appl. No. 12/386,473, filed Apr. 16, 2009, 2009-0214505, Aug. 27, 2009.
U.S. Appl. No. 12/387,225, filed Apr. 28, 2009, 2009-0304665, Dec. 10, 2009.
U.S. Appl. No. 12/455,657, filed Jun. 3, 2009, 2009-0253175, Oct. 8, 2009.
U.S. Appl. No. 12/653,245, filed Dec. 9, 2009, 2010-0143457, Jun. 10, 2010.
U.S. Appl. No. 12/735,868, filed Aug. 20, 2010, 2011-0053247, Mar. 3, 2011.
U.S. Appl. No. 12/928,890, filed Dec. 21, 2010, 2011-0152359, Jun. 23, 2011.
U.S. Appl. No. 13/135,817, filed Jul. 15, 2011, 2012-0020951, Jan. 26, 2012.
U.S. Appl. No. 13/374,248, filed Dec. 15, 2011, 2012-0093770, Apr. 19, 2012.
U.S. Appl. No. 13/374,500, filed Dec. 28, 2011.
U.S. Appl. No. 13/385,527, filed Feb. 21, 2012.
Letter/Written Disclosure of the Supplemental Information Disclosure Statement for the above-referenced application, dated Apr. 25, 2012, 2 pages.
Adams et al., "The c-myc oncogene driven by immunoglobulin enhancers induces lymphoid malignancy in transgenic mice," Nature 318:533-538 (1985).
Afify et al., "Purification and characterization of human serum hyaluronidases," Arch. Biochem. Biophys. 305:434-441 (1993).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Ansel, H., Introduction to Pharmaceutical Dosage Forms, Fourth Edition, Lea & Febiger:Philadelphia, p. 126 (1985).
Anttila et al., "High levels of stromal hyaluronan predict poor disease outcome in epithelial ovarian cancer," Cancer Rearch 60:150-155 (2000).
Arming et al., "In vitro mutagenesis of PH-20 hyaluronidase from human sperm," Eur J Biochem 247(3):810-814 (1997).
Arndt et al., "Helix-stabilized Fv (hsFv) antibody fragments: substituting the constant domains of a Fab fragment for a heterodimeric coiled-coil domain," J Mol Biol. 7:312:221-228 (2001).
Auvinen, P. "Hyaluronan in Peritumoral Stroma and Malignant Cells Associates with Breast Cancer Spreading and Predicts Survival" American Journal of Pathology vol. 156 No. 2 Feb. 2000 529-536.
Bacchus et al., Serum seromucoid and acid mucopolysaccharide in malignant neoplastic diseases. Cancer 18(10):1285-1291 (1965).
Baumgartner et al., "Phase I study in chemoresistant loco-regional malignant disease with hyaluronidase," Reg. Cancer Treat. 1:55-58 (1988).
Baumgartner et al.,"The impact of extracellular matrix on the chemoresistancce of solid tumors-experimental and clinical results of hyaluronidase as additive to cytostatic chemotherapy" Cancer Lett. Sep. 11, 1998;131(1):85-99.
Beckenlehner et al., "Hyaluronidase enhances the activity of adriamycin in breast cancer models in vitro and in vivo," J. Cancer Res. Oncol. 118:591-596 (1992).
Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).
Bernoist, C. and P. Chambon, "In vivo sequence requirements of the SV40 early promotor region," Nature 290:304-310 (1981).
Bertrand et al., "Hyaluronan (hyaluronic acid) and hyaluronectin in the extracellular matrix of human breast carcinomas: comparison between invasive and non-invasive areas," Int. J. Cancer 52:1-6 (1992).
Bioworld Today, "AACR Roundup," by Trista Morrison featuring Halozyme Therapeutics and PEGPH20, 20(75):8 (2009).
BioWorld Today, "Clinic Roundup," BioWorld Today 20(61):11 (2009).
BioWorld Today, "Clinic Roundup," BioWorld Today 21(236):2 (2010).
Bjermer et al., "Hyaluronate and type III procollagen peptide concentrations in bronchoalveolar lavage fluid as markers of disease activity in farmer's lung," Br Med J Clin Res Ed. 295(6602):803-806 (1987).
Boesen et al., "Circumvention of chemotherapy-induced myelosuppression by transfer of the mdr1 gene," Biotherapy 6:291-302 (1994).
Bookbinder et al., "A Recombinant human enzyme for enhanced interstitial transport of therapeutics," J Control Release 114:230-241 (2006).
Bordier, C., "Phase separation of integral membrane proteins in Triton X-114 solution," J Biol Chem. 256(4):1604-1607 (1981).
Brekken et al., "Hyaluronidase reduces the interstitial fluid pressure in solid tumors in a non-linear concentraion-dependent manner," Cancer Letters 131:65-70 (1998).
Brekken et al., "Hyaluronidase-induced periodic modulation of the interstitial fluid pressure increases selective antibody uptake in human osteosarcoma xenografts," Anticancer Res 20:3513-3519 (2000).
Brinster et al., "Regulation of metallothionein—thymidine kinase fusion plasmids injected into mouse eggs," Nature 296:39-42 (1982).
Brumeanu et al., "Derivatization with monomethoxypolyethylene glycol of Igs expressing viral epitopes obviates adjuvant requirements," J Immunol. 154:3088-3095 (1995).
Caliceti, P. and F. Veronese, "Pharmacokinetic and biodistribution properties of poly(ethylene glycol)-protein conjugates,"Adv. Drug Deliv. Rev. 55(10):1261-1277 (2003).
Camenisch et al., "Disruption of hyaluronan synthase-2 abrogates normal cardiac morphogenesis and hyaluronan-mediated transformation of epithelium to mesenchyme" J Clin Invest 2000; 106:349-360.
Carmichael et al., "Phase II study of gemcitabine in patients with advanced pancreatic cancer." Brit J Cancer 73:101-105 (1996).
Carrillo et al., "The multiple-sequence alignment problem in biology," SIAM J Applied Math 48:1073-1082 (1988).
Chapman et al., "Therapeutic antibody fragments with prolonged in vivo half-lives," Nature Biotech. 17:780-783 (1999).
Cheng et al., "Poly(ethylene glycol) modification of beta-glucuronidase-antibody conjugates for solid-tumor by targeted activation of glucuronide prodrugs," Cancer Immunology Immunother, 44(6):305-315 (1997).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol. 20:515-525 (2001).

(56) References Cited

OTHER PUBLICATIONS

Cherr et al., "The PH-20 protein in cynomolgus macaque spermatozoa: identification of two different forms exhibiting hyaluronidase activity," Dev. Biol. 175:142-153 (1996).
Civalleri et al., "Effects of adjuvant hyaluronidase in tumors refractory to chemotherapy. Review of the literature and pharmacokinetics of cisplatin after regional administration in animals and humans," G Chir 18(4):175-181 (1997).
Clinical Trials.gov, "Safety Study of PEGPH20 Given to patients with advanced solid tumors," Published on Jul. 27, 2010 [online][retrieved on Jan. 29, 2004] Retrieved from:<URL:clinicaltrials.gov/ct2/show/NCT00834704?term=PEGPH20&rank=1 [4 pages].
Clinical Trials.gov, "Study of PEGPH20 with initial dexamethasone premedication given intravenously to patients with advanced solid tumors," Published on Jul. 27, 2010 [online][retrieved on Jul. 26, 2010] Retrieved from:<URL:clinicaltrials.gov/ct2/show?term=PEGPH20&rank=2 [4 pages].
Clinical Trials.gov, "HALO-109-102 study of PEGPH20 with dexamethasone (PEG2)," Published on Jul. 26, 2010 [online][retrieved on May 2, 2011] Retrieved from:<URL:clinicaltrials.gov [1 page].
Conserved domain search from U.S. Appl. No. 10/795,095 of SEQ ID No. 6, Primakoff et al. U.S. Pat. No. 5,721,348, performed on the NCBI website on Aug. 5, 2008.
Csoka et al., "Hyaluronidases in tissue invasion," Invasion Metastasis 17:297-311 (1997).
Csoka et al., "Purification and microsequencing of hyaluronidase isozymes from human urine," FEBS Lett., 417(3):307-310 (1997).
Culty et al., "The hyaluronan receptor (CD44) participates in the uptake and degradation of hyaluronan," J Cell Biol. 116(4):1055-1062 (1992).
Czejka et al., "Influence of hyaluronidase on the blood plasma levels of 5-fluorouracil in patients," Pharmazie 45:H.9 (1990).
Dahl et al. "A longitudinal study of the hyaluronan level in the serum of patients with malignant mesothelioma under treatment. Hyaluronan as an indicator of progressive disease" Cancer 64(1):68-73 (1989).
Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).
Davies et al., "Radiation improves the distribution and uptake of liposomal doxorubicin (caelyx) in human osteosarcoma xenograph," Cancer Research, 64:547-553 (2004).
de Lange Davies et al., "Uptake of IgG in osteosarcoma correlates inversely with interstitial fluid pressure, but not with interstitial constituents," Br J Cancer 85(12):1968-1977 (2001).
De Maeyer et al., "The growth rate of two transplantable murine tumors, 3LL lung carcinoma and B16F10 melanoma, is influenced by Hyal-1, a locus determining hyaluronidase levels and polymorphism," Int. J. Cancer 51:657-660 (1992).
DeBoer et al., "The tac promoter: a functional hybrid derived from the trp and lac promoters," Proc. Natl. Acad. Sci. USA 80:21-25 (1983).
Delpech et al., "Immunoenzymoassay of the hyaluronic acid-hyaluronectin interaction: application to the detection of hyaluronic acid in serum of normal subjects and cancer patients," Anal Biochem 149(2):555-565 (1985).
Delpech et al., "Enzyme-linked hyaluronectin: a unique reagent for hyaluronan assay and tissue location and for hyaluronidase activity detection," Anal. Biochem. 229:35-41 (1995).
Derwent Abstract for WO 1988002261. Inventor: Baumgartne et al., WPI Acc No. 1988-105412/198815, Abstract published 1988, 2 pages.
Devereux et al., "A comprehensive set of sequence analysis programs for the VAX," Nucleic Acids Research 12:387-395 (1984).
Dorfman, A. and M. Ott, "A turbidimetric method for the assay of hyaluronidase," J. Biol. Chem. 172:367-375 (1948).
Drug Shortage Bulletin: Hyaluronidase Injection—Discontinued, published Jan. 18, 2005, American Society of Health-System Pharmacist, www.ashp.org/shortage/hyaluronidase.cfm?cfid=11944667&CFToken=9426953%2, last accessed Mar. 21, 2006.
Drugs R&D, "Hyaluronidase (Vitrase®)—ISTA," 4(3):194-197 (2003).
Dubensky et al., "Direct transfection of viral and plasmid DNA into the liver or spleen of mice," Proc Natl Acad Sci U S A 81(23):7529-7533 (1984).
Egberts et al. "Dexamethasone reduces tumor recurrence and metastasis after pancreatic tumor resection in SCID mice," Cancer Biol Ther 7(7):1044-50 (2008).
Eikenes et al., "Hyaluronidase induces a transcapillary pressure gradient and improves the distribution and uptake of liposomal doxorubicin (Caelyx) in human osteosarcoma xenografts," British Journal of Cancer 93:81-88 (2005).
Elder et. al, "Intra-arterial hyaluronidase in severe peripheral arterial disease," Lancet 648-649 (1980).
Ernst et al., "Enzymatic degradation of glycosaminoglycans," Critical Reviews in Biochemistry and Molecular Biology 30(5):387-444 (1995).
Fadnes et al., "Interstitial fluid pressure in rats measured with a modified wick technique," Microvasc. Res. 14(1):27-36 (1977).
Favre et al, "Hyaluronidase enhances recombinant adeno-associated virus (rAAV)-mediated gene transfer in the rat skeletal muscle," Gene Ther 7(16):1417-1420 (2000).
Federal Register Sep. 23, 1970 (35 FR 14800); Wydase NDA 6-343, 40 pages.
Felix et al., "Pegylated peptides. IV. Enhanced biological activity of site-directed pegylated GRF analogs," Int. J. Peptide Res. 46:253-264 (1995).
Few, B., "Hyaluronidase for treating intravenous extravasations," MCN Amer. J. Matern. Child Nurs. 12(1):23-26 (1987).
Form 10-Q for Halozyme Therapeutics, Published on May 8, 2009[online][retrieved on Nov. 25, 2009] Retrieved from:<URL:biz.yahoo.com/e/090508/halo10-q.html [6 pages].
Fraser et al., "Hyaluronan: it's nature, distribution, functions and turnover." J Intern Med 242:27-33 (1997).
Frost et al., "HYAL1LUCA-1, a candidate tumor suppressor gene on chromosome 3p21.3, is inactivated in head and neck squamous cell carcinomas by aberrant splicing of pre-mRNA," Oncogene, 19:870-877 (2000).
Frost et al., "Purification, cloning, and expression of human plasma hyaluronidase," Biochem. Biophys. Res. Commun. 236:10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Fruijtier-Pölloth, C, "Safety assessment on polyethylene glycols (PEGs) and their derivatives as used in cosmetic products," Toxicology 214(1-2):1-38 (2005).
Gabizon et al., "Pharmacokinetics of pegylated liposomal Doxorubicin: review of animal and human studies," Clin Pharmacokinet 42:419-436 (2003).
Ganesh et al., "Intratumoral coadministration of hyaluronidase enzyme and oncolytic adenoviruses enhances virus potency in metastatic tumor models," Clin. Cancer Res 12:3933-3941 (2008).
Gardner et al., "The complete nucleotide sequence of an infectious clone of cauliflower mosaic virus by M13mp7 shotgun sequencing," Nucleic Acids Res. 9:2871-2888 (1981).
Gellene, D, "San Diego's Halozyme injects new life into old drugs," Published on Feb. 28, 2010 [online][retrieved on Apr. 26, 2010] Retrieved from:<URL:signonsandiego.com/news/2010/feb/28/wwwxconomycom60025/, on Apr. 26, 2010 1 [3 pages].
Gilbert, W. and L. Villa-Komaroff, "Useful proteins from recombinant bacteria," Scientific American 242(4):74-94 (1980).
Gmachl et al., "The human sperm protein PH-20 has hyaluronidase activity," FEBS 336(3):545-548 (1993).
Gribskov et al., "Sigma factors from E. coli, B. subtilis, phage SP01, and phage T4 are homologous proteins," Nucl. Acids Res. 14(16):6745-6763 (1986).
Griffon-Etienne et al., "Taxane-induced apoptosis decompresses blood vessels and lowers interstitial fluid pressure in solid tumors: clinical implications," Cancer Research 59:3776-3782 (1999).

(56) References Cited

OTHER PUBLICATIONS

Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaA1a for protein conjugation," Bioorg. Med. Chem. Lett. 12:177-180 (2002).
Guo et al., "Protein tolerance to random amino acid change," Proc. Nat'l. Acad. Sci. USA 101:9205-9210 (2004).
Haller et al., "Escaping the interstitial matrix with enzyme-mediated drug delivery," Drug Delivery Technology, 5(5):1-6 (2005).
Haller, M., "Converting intravenous dosing to subcutaneous dosing with recombinant human hyaluronidase," Pharmaceut Tech. Newsletter, Oct. 2007, 14 pgs.
Hallgren et al, "Accumulation of hyaluronan (hyaluronic acid) in myocardial interstitial tissue parallels development of transplantation edema in heart allografts in rats," J Clin Invest 85:668-673 (1990).
Hallgren et al, "Hyaluronic acid accumulation and redistribution in rejecting rat kidney graft. Relationship to the transplantation edema," J Exp Med. 171:2063-2076 (1990).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature (3)15:115-122 (1985).
Harris, J., "Effect of pegylation on pharmaceuticals," Nat Rev Drug Discov 2(3):214-221 (2003).
Heldin, C., "High interstitial fluid pressure—an obstacle in cancer therapy." Nat Rev Cancer, 4(10):806-813 (2004).
Heldin, P., "Importance of hyaluronan biosynthesis and degradation in cell differentiation and tumor formation," Brazilian J. Med. Biol. Res. 36:967-973 (2003).
Herrera-Estrella et al., "Expression of chimaeric genes transferred into plant cells using a ti-plasmid-derived vector,"Nature 303:209-213 (1984).
Herrera-Estrella et al., "Light-inducible and chloroplast-associated expression of a chimaeric gene introduced into Nicotiana tabacum using a Ti plasmid vector," Nature 310(5973):115-120 (1984).
Hibi et al., "Chondroitinase C activity of *Streptococcus intermedius*," FEMS—Microbiol-Lett. 48(2):121-124 (1989).
Horn et al., "Intravesical chemotherapy of superficial bladder tumors in a controlled trial with cis-platinum versus cis-platinum plus hyaluronidase," J. Surg. Oncol. 28:304-307 (1985).
Hovingh et al., "Hyaluronidase activity in leeches (Hirudinea)," Comp Biochem Physiol B Biochem Mol Biol. 124(3):319-326 (1999).
Hunnicut et al., "Structural relationship of sperm soluble hyaluronidase to the sperm membrane protein PH-20," Biol Reprod. 54(6):1343-1349 (1996).
Itano et al., "Altered hyaluronan biosynthesis in cancer progression," Seminars in Cancer Biology 18:268-274 (2008).
Itano et al., "Impact of the hyaluronan-rich tumor microenvironment on cancer initiation and progression," Cancer Sci 99(9):1720-1725 (2008).
Itano et al., "Abnormal accumulation of hyaluronan matrix diminishes contact inhibition of cell growth and promotes cell migration," Proc. Natl. Acad. Sci. U.S.A. 99(6):3609-3614 (2002).
IUPAC-IUB Commission on Biochemical Nomenclature Biochem. 11:942-944 (1972).
IUPAC-IUB, "Abbreviated nomenclature of synthetic poypeptides-polymerized amino acids-revised recommendations," Commission on Biochemical Nomenclature, Biochemistry 11:1726-1731 (1972).

Jay et al., "Construction of a general vector for efficient expression of mammalian proteins in bacteria: use of a synthetic ribosome binding site," Proc. Natl. Acad. Sci. USA 78:5543-5548 (1981).
Jenkins et al "In vivo monitoring of tumor replase and metastasis using bioluminescent PC-3M-luc-C6 cells in murine models of human prostate cancer," Clinical and Experimental Metastasis 20:745-756 (2003).
Jevsevar et al., "PEGylation of therapeutic proteins." Biotechnol J. 5:113-128 (2010).
Johnsson et al., "Hyaluronidase ameliorates rejection-induced edema," Transplant Int 12:235-243 (1999).
Johnsson et al., "Hyaluronidase can be used to reduce interstitial edema in the prescence of heparin," Journal of Cardiovascular Pharmacology and Therapeutics 5(3):229-236 (2000).
Karvinen et al., "Hyaluronan, CD44 and versican in epidermal keratinocyte tumors," British Journal of Dermatology 148:86-94 (2003).
Keenan et al., "Standard morphologic evaluation of the heart in the laboratory dog and monkey." Tpxocp; {atjp; 34(1):67-74 (2006).
Kelsey et al., "Species- and tissue-specific expression of human alpha 1-antitrypsin in transgenic mice," Genes and Devel. 1:161-171 (1987).
Kim et al., "Hyaluronan facilitates invasion of colon carcinoma cells in vitro via interaction with CD44," Cancer Research 64(13):4569-4576 (2004).
Kimata et al., "Increased synthesis of hyaluronic acid by mouse mammary carcinoma cell variants with high metastatic potential," Cancer Res. 43:1347-1354 (1983).
Klocker et al., "Combined application of cisplatin, vindesine, hyaluronidase and radiation for treatment of advanced squamous cell carcinoma of the head and neck," Am. J. Clin. Oncol. 18:425-428 (1995).
Klocker et al., "Hyaluronidase as additive to induction chemotherapy in advanced squamous cell carcinoma of the head and neck," Cancer Lett 131:113-115 (1998).
Knudson et al, "Hyaluronan-binding proteins in development, tissue homeostasis, and disease," FASEB J. 7:1233-1241 (1993).
Kohno et al., "Effects of hyaluronidase on doxorubicin penetration into squamous carcinoma multicellular tumor spheroids and its cell lethality," J. Cancer Res. Oncol. 120:293-297 (1994).
Kollias et al., "Regulated expression of human A gamma-, beta-, and hybrid gamma beta-globin genes in transgenic mice: manipulation of the developmental expression patterns," Cell 46:89-94 (1986).
Kolodgie et al, "Differential accumulation of proteoglycans and hyaluronan in culprit lesions: insights into plaque erosion," Arterioscler Thromb Vasc Biol. 22(10):1642-1648 (2002).
Kosaki et al., "Overproduction of hyaluronan by expression of the hyaluronan synthase Has2 enhances anchorage-independent growth and tumorigenicity" Cancer Res 59:1141-1145 (1999).
Koyama et al., "Hyperproduction of hyaluronan in neu-induced mammary tumor accelerates angiogenesis through stromal cell recruitment: possible involvement of versican/PG-M," Am J Pathol. 170(3):1089-1099 (2007).
Kozak et al., "The effect of recombinant human hyaluronidase on dexamethasone penetration into the posterior segment of the eye after sub-tenon's injection," Journal of Ocular Pharmacology and Therapeutics, 22(5):362-369 (2006).
Kriel, K., "Hyaluronidases—a group of neglected enzymes," Protein Sci. 4(9):1666-1669 (1995).
Krumlauf et al., Developmental regulation of alpha-fetoprotein genes in transgenic mice, Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32:785-790 (1996).
Kudawara et al., "In vivo inhibition of tumour growth by dexamethasone," European Journal of Cancer, 37:1703-1708 (2001).
Kultti et al., "Hyaluronan synthesis induces microvillus-like cell surface protrusions" J Biol Chem 281:15821-15828 (2006).
Lalancette et al, "Characterization of an 80-kilodalton bull sperm protein identified as PH-20," Biol Reprod. 65(2):628-636 (2001).

(56) References Cited

OTHER PUBLICATIONS

Lathrop et al., "cDNA cloning reveals the molecular structure of a sperm surface protein, PH-20, involved in sperm-egg adhesion and the wide distribution of its gene among mammals," J Cell Biol. 111(6 Pt 2):2939-2949 (1990).
Laurent et al, "Hyaluronan in human cerebrospinal fluid," Acta Neurol Scand 94(3):194-206 (1996).
Laurent, T. and J. Fraser, "Hyaluronan," FASEB J 6:2397-2404 (1992).
Leder et al., "Consequences of widespread deregulation of the c-myc gene in transgenic mice: multiple neoplasms and normal development," Cell 45:485-495 (1986).
Li et al., "Silencing of hyaluronan synthase 2 suppresses the malignant phenotype of invasive breast cancer cells" Int J Cancer 120:2557-2567 (2007).
Li et al., "Irradiation-induced expression of hyaluronan (HA) synthase 2 and hyaluronidase 2 genes in rat lung tissue accompanies active turnover of HA and induction of types I and III collagen gene expression," Am. J. Respir. Cell Mol. Biol. 23:411-418 (2000).
Lin et al., "Molecular cloning of the human and monkey sperm surface protein PH-20," Proc. Natl. Acad. Sci. USA 90:10071-10075 (1993).
Lipponen et al "High stromal hyaluronan level is associated with poor differentiation and metastasis in prostate cancer" European Journal of Cancer 37 (2001) 849-856.
Lokeshwar et al., "Tumor-associated hyaluronic acid: a new sensitive and specific urine marker for bladder cancer," Cancer Res. 57(4):773-777 (1997).
Lokeshwar et al., "Urinary hyaluronic acid and hyaluronidase: markers for bladder cancer detection and evaluation of grade," J. Urol. 163(1):348-356 (2000).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
Macdonald, R., "Expression of the pancreatic elastase I gene in transgenic mice," Hepatology 7:425-515(1987).
MacKenzie et al., Chapter 28—Heart. In *Pathology of the Fisher Rat. Reference and Atlas.* Academic Press:San Diego, 464-465 (1990).
Maclean, et. al., "Hyaluronidase-induced reductions in myocardial infarct size," Science 194(4261):199-200 (1976).
Magram et al., "Developmental regulation of a cloned adult beta-globin gene in transgenic mice," Nature 315:338-340 (1985).
Magzoub et al., "Enhanced macromolecule diffusion deep in tumors after enzymatic digestion of extracellular matrix collagen and its associated proteoglycan decorin," FASEB J 1:276-284 (2008).
Maier et al., "Metaphylactic effect of mitomycin C with and without hyaluronidase after transurethral resection of bladder cancer: Randomized trial," J Urol 141:529-530 (1989).
Mammalian Gene Collection (MGC) Program Team, "Generation and initial analysis of more than 15,000 full-length human and mouse cDNA sequences," Proc. Natl. Acad. Sci. USA 99:16899-16903 (2002).
Mantovani et al., "Efficacy of varying concentrations of hyaluronidase in peribulbar anaesthesia," British J. Anaesthesia 86:876-878 (2001).
Mason et al., "The hypogonadal mouse: reproductive functions restored by gene therapy," Science 234:1372-1378 (1986).
Matousek et al., "Effect of hyaluronidase and PEG chain conjugation on the biologic and antitumor activity of RNase A," J Control Release 94(2-3):401-410 (2004).
Mehvar et al., "Modulation of the pharmacokinetics and pharmacodynamics of proteins by polyethylene glycol conjugation," J. Pharm. Pharmaceut. Sci. 3(1):125-136 (2000).
Menzel, E. and C. Farr, "Hyaluronidase and its substrate hyaluronan: biochemistry, biological activities and therapeutic uses," Cancer Lett., 131:3-11 (2003).

Meyer et al., "The soluble hyaluronidase from bull testes is a fragment of the membrane-bound PH-20 enzyme." FEBS Letters 413(2):385-388 (1997).
Michelacci et al., "Chondroitinase C from Flavobacterium heparinum," J. Biol. Chem. 251:1154-1158 (1976).
Modena et al., "Hyaluronidase-injectable microparticles intended for the treatment of extravasation," J. Microencapsulation, 15(1):85-92 (1998).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6: 62-69 (1995).
Muckenschnabel et al., "Pharmacokinetics and tissue distribution of bovine testicular hyaluronidase and vinblastine in mice: an attempt to optimize the mode of adjuvant hyaluronidase administration in cancer chemotherapy," Cancer Lett 131:71-84 (1988).
Nadjsombati et al., "Dose-range developmental toxicity of rHuPH20 in mice," Matrix Biology 27:23 (2008).
Natowicz et al., "Clinical and biochemical manifestations of hyaluronidase deficiency" New Eng J Med 335(14): 1029-1033 (1996).
Needleman, S. and C. Wunsch "A general method applicable to the search for similarities in the amino acid sequence of two proteins," J Mol Biol. 48:443-453 (1970).
Nektar Advanced PEGylation Product Catalog 2005-2006, "Amine PEGylation," pp. 10-11.
Nettelbladt et al, "Accumulation of hyaluronic acid in the alveolar interstitial tissue in bleomycin-induced alveolitis," Am Rev Resp Dis 139:759-762 (1989).
Nishida "Antisense inhibition of hyaluronan synthase-2 in human osteosarcoma cells inhibits hyaluronan retention and tumorigenicity" Exp Cell Res 307(1):194-203 (2005).
Ohya, T., and Y. Kaneko, "Novel hyaluronidase from streptomyces," Biochim. Biophys. Acta 198:607-609 (1970).
Oncolology—Halozyme Therapeutics, [online][retrieved on Jan. 21, 2010] Retrieved from:<URL:halozyme.com/products_oncology.php [3 pages].
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Oupicky et al., "Stabilization of polycation-DNA complexes by surface modification with hydrophilic polymers," Methods in Molecular Medicine 65:61-64 (2001).
Ozerdem, U. and A. Hargens, "A simple method for measuring interstitial fluid pressure in cancer tissues," Microvasc. Res. 70:116-120 (2005).
Ozzello et al., "Growth-promoting activity of acid mucopolysaccharides on a strain of human mammary carcinoma cells," Cancer Res. 20:600-604 (1960).
Park et. al, "The role of diffusion-weighted imaging and the apparent diffusion coefficient (ADC) values for breast tumors," Korean J Radiol. (5):390-396 (2007).
Paul, A. and D. Sochart, "Improving the results of ganglion aspiration by the use of hyaluronidase," J Hand Surg 22(2):219-221 (1997).
Pawlowski et al., "The effects of hyalurodinase upon tumor formation in BALB/c mice painted with 7,12-dimethylbenz-(a)anthracene," Int. J. Cancer 23:105-109 (1979).
Pearson, W. and D. Lipman "Improved tools for biological sequence comparison," Proc. Natl. Acad. Sci. USA 85:2444-2448 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pillwein et al., "Hyaluronidase additional to standard chemotherapy improves outcome for children with malignant brain tumors." Cancer Lett 131:101-108 (1998).
Pinkert et al., "An albumin enhancer located 10 kb upstream functions along with its promoter to direct efficient, liver-specific expression in transgenic mice," Genes and Devel. 1:268-276 (1987).

(56) References Cited

OTHER PUBLICATIONS

Pirinen et al "Prognostic value of hyaluronan expression in non-small cell lung cancer: Increased stromal expression indicated unfavorable outcome in patients with adenocarcinoma," Int. J. Cancer 95:12-17 (2001).
Pirrello et al., "Initial experiences with subcutaneous recombinant human hyaluronidase," J Palliat Med. 10(4):861-864 (2007).
Readhead et al., "Expression of a myelin basic protein gene in transgenic shiverer mice: correction of the dysmyelinating phenotype," Cell 48:703-712 (1987).
Roberts et al., "Chemistry for peptide and protein PEGylation," Advanced Drug Delivery Review 54:459-476 (2002).
Ropponen et al., "Tumor cell-associated hyaluronan as an unfavorable prognostic factor in colorectal cancer," Cancer Research 58:342-347 (1998).
Rosenthal et al., "Phase I and pharmacokinetic evaluation of intravenous hyaluronic acid in combination with doxorubicin or 5-Fluorouracil," Chemotherapy 51:132-141 (2005).
Salkie, M., "Glycosaminoglycan metabolism following acute myocardial infarction and the effects of intraveneous hyaluronidase therapy," Clin. Biochem. 13(2):92-94 (1980).
Sato et al., "Cloning and expression in *Escherichia coli* of the gene encoding the Proteus vulgaris chondroitin ABC lyase," Appi. Microbiol. Biotechnol. 41(1):39-46 (1994).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Scheithauer et al., "In vitro evaluation of the anticancer drug modulatory effect of hyaluronidase in human gastrointestinal cell lines," Anticancer Res. 8:391-396 (1988).
Schuller et al., "Pharmacokinetics of intrahepatic 5-fluorouracil + preinjected hyaluronidase," Proc. Amer. Assoc. Cancer Res. 32:173, abstract No. 1034 (1991).
Schwartz, R. and M. Dayhoff, eds., "Matrices for detecting distant relationships," *Atlas of Protein Sequence and Structure*, National Biomedical Research Foundation, pp. 353-358 (1979).
Schwartzman, J., "Hyaluronidase: A review in its therapeutic use in pediatrics," J. Pediat. 39:491-502 (1951).
Sequence alignments from U.S. Appl. No. 10/795,095 search of SEQ ID No. 1 in the Issued Patents database, performed on Sep. 25, 2007, 13 pages.
Setala et al., "Hyaluronan expression in gastric cancer cells is associated with local and nodal spread and reduced survival rate," Br J Cancer 79(7-8):1133-1138 (1999).
Shani, M., "Tissue-specific expression of rat myosin light-chain," Nature 314:283-286 (1985).
Shekhar et al., "The matrix reloaded: Halozyme's recombinant enzyme helps injected drugs spread faster," Chem. Biol. 14:603-604 (2007).
Shuster et al., "Hyaluronidase reduces human breast cancer xenografts in SCID mice," Int. J. Cancer 102:192-197 (2002).
Simpson et al., "Inhibition of prostate tumor cell hyaluronan synthesis impairs subcutaneous growth and vascularization in immunocompromised mice," Am J Pathol 161(3):849-857 (2002).
Smith et al., "Hyaluronidase enhances the therapeutic effect of vinblastine in intralesional treatment of Kaposi's sarcoma," J. Am. Acad Dermatol 36:239-242 (1997).
Smith et al., "Effect of intraarticular hyaluronan injection in experimental canine osteoarthritis," Arthritis Rheum 41(6):976-985 (1998).
Smith, T. and M. Waterman, "Comparison of biosequences," Advances in Applied Mathematics 2:482-489 (1981).
Spruss et al., "Hyaluronidase significantly enhances the efficacy of regional vinblastine chemotherapy of malignant melanoma." J Cancer Res Clin Oncol 121:193-202 (1995).
St Croix et al., "Reversal of intrinsic and acquired forms of drug resistance by hyaluronidase treatment of solid tumors," Cancer Lett 131(1):35-44 (1998).

Stern, R., "Devising a pathway for hyaluronan catabolism: are we there yet?" Glycobiology 13:105R-115R (2003).
Stuhlmeier et al., "Glucocorticoids inhibit induced and non-induced mRNA accumulation of genes encoding hyaluronan synthases (HAS): hydrocortisone inhibits HAS1 activation by blocking the p38 mitogen-activated protein kinase signalling pathway," Rheumatology (Oxford) 43:164-169 (2004).
Swift et al., "Tissue-specific expression of the rat pancreatic elastase I gene in transgenic mice," Cell 38:639-646 (1984).
Takahashi et al., "A fluorimetric Morgan-Elson assay method for hyaluronidase activity," Anal. Biochem. 322:257-263 (2003).
Takeuchi et al., "Variation in glycosaminoglycan components of breast tumors," Cancer Res. 36:2133-2139 (1976).
Tammi et al., "Hyaluronan in human tumors: pathobiological and prognostic messages from cell-associated and stromal hyaluronan," Seminar in Cancer Biology 18:288-395 (2008).
Therasse et al., "New guideline to evaluate the response to treatment in solid tumors," JNCI 92(3):205-216 (2000).
Thompson et al., "Enzymatic depletion of tumor hyaluronan induces antitumor responses in preclinical animal models," Molecular Cancer Therapeutics 9(11):3052-3064 (2010).
Thylen et al., "Hyaluronan in serum as an indicator of progressive disease in hyaluronan-producing malignant mesothelioma," Cancer 86(10):2000-2005 (1999).
Tkalec et al., "Isolation and expression in *Escherichia coli* of cs1A and cs1B, genes coding for the chondroitin sulfate-degrading enzymes chondroitinase AC and chondroitinase B, respectively, from Flavobacterium heparinum," Applied and Environmental Microbiology 66(1):29-35 (2000).
Toole et al., "Hyaluronan promotes the malignant phenotype," Glycobiology 12(3): 37R-42R, (2002).
Tsubery et al., "Prolonging the action of protein and peptide drugs by a novel approach of reversible polyethylene glycol modification.," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).
Tyle, P., "Iontophoretic devices for drug delivery," Pharmaceutical Research 3(6):3-18 (1986).
Udabage L., "Antisense-mediated suppression of hyaluronan synthase 2 inhibits the tumorigenesis and progression of breast cancer," Cancer Res. 65(14):6139-6150 (2005).
USP XXII-NF XVII, United States Pharmacopeia Convention, Inc, Rockville, MD., pp. 644-645 (1990).
Vaage et al., "Tissue distribution and therapeutic effect of intravenous free or encapsulated liposomal doxorubicin on human prostate carcinoma xenografts," Cancer 73:1478-1484 (1994).
Veronese et al., "Branched and linear poly(Ethylene Glycol): Influence of the polymer structure on enzymological, pharmacokinetic, and immunological properties of protein conjugates," J. Bioactive Compatible Polymers 12:197-207 (1997).
Wagner et al., "Nucleotide sequence of the thymidine kinase gene of herpes simplex virus type 1," Proc. Natl. Acad. Sci. USA 78:1441-1445 (1981).
Waldenstrom et al, "Accumulation of hyaluronan and tissue edema in experimental myocardial infarction," J Clin Invest 88(5):1622-1628 (1991).
Waldenstrom et al, "Coxsackie B3 myocarditis induces a decrease in energy charge and accumulation of hyaluronan in the mouse heart," Eur J Clin Invest 23:277-282 (1993).
Wallander et al, "Intestinal distribution of hyaluronan in small bowel allografting in the rat," Transplant Int 6:133-137 (1993).
Wells et al, "The localization of hyaluronan in normal and rejected human kidneys," Transplantation 1990; 50: 240-243 (1990).
Williams, R., "The Effects of Continuous Local Injection of Hyaluronidase on Skin and Subcutaneous Tissue in Rats," Anat. Rec. 122:349-361 (1955).
Wu et al., "Hyperviscosity caused by hyaluronic acid in serum in a case of Wilms' tumor," Clin Chem 30(6):914-916 (1984).

(56) References Cited

OTHER PUBLICATIONS

Yamagata et al., "Purification and properties of bacterial chondroitinases and chondrosulfatases," J. Biol. Chem. 243:1523 (1968).

Yamamoto et al., "Identification of a functional promoter in the long terminal repeat of Rous sarcoma virus," Cell 22:787-797 (1980).

Yang et al., "Purification and characterization of heparinase from Flavobacterium heparinum," J. Biol. Chem. 160(30):1849-1857 (1985).

Yocum et al., "Assessment and Implication of the Allergic Sensitivity to a Single Dose of Recombinant Human Hyaluronidase Injection: A Double-Blind Placebo-Controlled Clinical Trial," J Infus Nursing. 30:293-299 (2007).

Zalipsky, S. and C. Lee, "Poly(ethyl ene glycol) Chemistry: Biotechnical and Biomedical Applications," J.M. Hams, ed., Plenum, NY, chapter 21, pp. 347-370 (1992).

Zalipsky, S., "Chemistry of polyethylene glycol conjugates with biologically active molecules," Adv. Drug Del. Rev. 16:157-182 (1995).

Zanker et al., "Induction of response in previous chemotherapy resistant patients by hyaluronidase," Proc. Amer. Assoc. Cancer Res. 27:390 Abstract 1550 (1986).

Zhang et al., "Glucocorticoids induce a near-total suppression of hyaluronan synthase mRNA in dermal fibroblasts and in osteoblasts: a molecular mechanism contributing to organ atrophy," Biochem. J. 349: 91-97 (2000).

Zhao, X. and J. Harris, "Novel degradable poly(ethylene glycol) esters for delivery," in Poly(ethylene glycol), Chemistry and Biological Applications, ACS Symposium Series 680, Hams, J. and S. Zalipsky, (eds), 458-472 (1997).

Zhou et al., "Identification of the hyaluronan receptor for endocytosis (HARE)" J. Biol Chem 275(48):37733-37741 (2000).

Angelborg et al., "The HYAL1LuCA1 Gene Is Inactivated in Breast Carcinomas by Hypermethylation/Chromatin condensation and Mediates Tumor Suppression In Vivo," Am Assoc Cancer Res Apr. 6-10, 2002. Abstract, 1 page.

Angelborg et al., "The HYAL1LuCA1 Gene Is Inactivated in Breast Carcinomas by Hypermethylation/Chromatin condensation and Mediates Tumor Suppression in Vivo," Am Assoc Cancer Res Apr. 6-10, 2002. Poster, 1 page.

Bee et al., "Recombinant human PH20 is well tolerated at higher intravenous and subcutaneous doses in cynomolgus monkeys," EUFEPS 2008, Munich, Germany. Abstract, 2 pages.

Bee et al., "Recombinant human PH20 is well tolerated at higher intravenous and subcutaneous doses in cynomolgus monkeys," EUFEPS 2008, Munich, Germany. Poster, 1 page.

Bookbinder et al., "Biochemical Characterization of Recombinant Human PH20 (SPAM1) Hyaluronidase," Hyaluronan (ISHAS) 2007, Charleston, SC. Abstract, 1 page.

Bookbinder et al., "Biochemical Characterization of Recombinant Human PH20 (SPAM1) Hyaluronidase," Hyaluronan (ISHAS) 2007, Charleston, SC, Poster, 1 page.

Bookbinder et al., "Enhancing Drug Transport Through Temporary Matrix Depolymerization," Keystone Symposia 2005, 1 page. Abstract, 1 page.

Pinkstaff et al., "Enhancing Drug Transport Through Temporary Matrix Depolymerization," Keystone Symposia 2005. Poster, 12 pages.

Bookbinder et al., "EnhanzeTM Technology for Antibody Dispersion," Strategic Research Institute Antibody World Summit, Jul. 24-27, 2005, Jersey City, NJ. Abstract, 1 page.

Bookbinder et al., "EnhanzeTM Technology for Antibody Dispersion," Strategic Research Institute Antibody World Summit, Jul. 24, 2005, Jersey City, NJ. Presentation, 40 pages.

Bookbinder et al., "Evaluation of the compatibility and pharmacokinetics of co-formulated biologics with recombinant human hyaluronidase: Dose Response," American Association of Pharmaceutical Scientists Conference, Nov. 2006. Abstract, 2 pages.

Bookbinder et al., "Evaluation of the compatibility and pharmacokinetics of co-formulated biologics with recombinant human hyaluronidase: Dose Response," American Association of Pharmaceutical Scientists Conference, Nov. 2006. Poster, 1 page.

Byerley et al., "'Cutting out the bull'. Recombinant human hyaluronidase: Moving to an animal-free system," Association of Clinical Embryologists, 2006, Dublin, Ireland. Abstract published in Human Fertility, Jun. 2006; 9(2):110.

Dychter et al., "Targeting hyaluronan in tumor stroma. Interim translational and biomarker evaluations of pegylated hyaluronidase (PEGPH20) in animal models and patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. European Journal oc Cancer 47(Suppl.4): S30-S31, PP60, abstract, 2 pages.

Frost et al., "Punctuated equilibrium: the evolution of recombinant human hyaluronidase," Ophthalmic Anesthesia Society, 2006, Chicago, IL, abstract, 1 page.

Frost et al., "Punctuated equilibrium: the evolution of recombinant human hyaluronidase," Ophthalmic Anesthesia Society, 2006, Chicago, IL, presentation, 35 pages.

Frost et al., "Subcutaneous strategies for monoclonal antibody delivery," Drug Delivery 2007: Where Science and Business Meet, 2007, San Diego, CA, 1 page.

Frost G., "Subcutaneous strategies for monoclonal antibody delivery," IBC Life Sciences Antibodies and Beyond Antibodies: Optimizing Antibody Leads and Exploring Next Generation Scaffolds for Protein Therapeutics, Coronado CA, 2006. presentation, 20 pages.

Frost, G., "Investor Presentation Jefferies 2011 Global Healthcare Conference," New York, NY Jun. 9, 2011, 22 pages.

Haller et al., "Recombinant human hyaluronidase for the interstitial transport of therapeutics," American Association of Pharmaceutical Scientists Conference, Jun. 2006, San Antonio, TX, Abstract, 1 page.

Haller et al., "Recombinant human hyaluronidase for the interstitial transport of therapeutics," American Association of Pharmaceutical Scientists Conference, Jun. 2006, San Antonio, Poster, 1 page.

Haller et al., "Recombinant human hyaluronidase for the interstitial transport of therapeutics," Controlled Release Society Conference, Vienna, Austria, 2006, Abstract, 1 page.

Haller et al., "Recombinant human hyaluronidase for the interstitial transport of therapeutics," Controlled Release Society Conference, Vienna, Austria, 2006, Poster, 1 page.

Haller et al., "The effects of recombinant human hyaluronidase on drug dispersion," American Association of Pharmaceutical Scientists Annual Meeting, Abstract in AAPS Journal 7(S2) May 5, 2005; 3 pages.

Haller et al., "Revolutionizing drug dispersion with enhanze technology," American Association of Pharmaceutical Scientists Annual Meeting, Nov. 6-10, 2005, Nashville, TN, Poster 1 page.

Haller et al., "Enhanze technology—a revolution in drug dispersion," Biotechnology Industry Organization (BIO) Annual Meeting, Jun. 19-22, 2005, Philadelphia, PA. Abstract, 3 pages.

Haller et al., "Revolutionizing drug dispersion with enhanze technology," Biotechnology Industry Organization (BIO) Annual Meeting, Jun. 19-22, 2005, Philadelphia, PA. Poster, 1 page.

Haller, "Enhanze technology—an enzymatic drug delivery system (DDS)," Japanese Export Trade Organization, Nov. 2005, Santa Clara, CA. Abstract, 2 pages.

Haller, "Focus on Enhanced and Innovative Recombinant Human Enzymes," Japanese Export Trade Organization, Sep. 2004, Chicago, IL., Presentation, 16 pages.

Haller, M., "Halozyme's enhanze technology for the enhanced dispersion of co-injected pharmaceuticals," Japanese Export Trade Organization, Sep. 2004, Chicago, IL, Abstract, 1 page.

Haller, M., "Halozyme's enhanze technology for the enhanced dispersion of co-injected pharmaceuticals," Japanese Export Trade Organization, Sep. 2004, Chicago, IL, Poster, 1 page.

Haller, M., "Enzyme-facilitated parenteral drug transport," Strategic Research Institute's 10th Anniversary Drug Delivery Technology and Deal-making Summit 2005, New Brunswick, Nj. Presentation, 24 pp.

(56) References Cited

OTHER PUBLICATIONS

Halozyme Therapeutics, J.P. Morgan 29th Annual Healthcare Conference Presentation, Jan. 12, 2011. Presentation, 35 pp.
Halozyme Therapeutics, "Matrix Therapies for Life" Presented at Canaccord Cardiovaschlar, Diabetes & Obesity Conference, Dec. 8, 2010. Presentation, 38 pp.
Halozyme Therapeutics, Analyst and Investor Meeting presentations "Matrix Therapeutics for Life," Presented 10/14/10 in New York. Presentation, 124 pp.
Halozyme Therapeutics, Analyst and Investor Meeting presentations including by Lim, J., "Introduction and strategic review," Little, R., "Leveraging the technology across multiple partners," Frost, G., "Discovery and early development pipeline update," and D. Muchmore, "Ultrafast insulin-PH2O program-where we are going." Presented 10.15.09 in New York. Oral Presentation, 88 pp.
Hofer et al., "Human recombinant hyaluronidase increases the convection of molecules up to 0.2 . . ."Abstract published in J. Am. Association Lab. Animal Sci., 45:120, (Jul. 2006). Abstract P97.
Hofer, "Human Recombinant Hyaluronidase Increases the Convection of Molecules up to 0.2 gm in Athymic Nude Mice," American Association for Laboratory Animal Science, 2006, Salt Lake City, Ut. Abstract published in J. Am. Assoc. Lab. Animal Sci., 45:120, 2006. Poster P97.
Halozyme Therapeutics Inc., Jefferies 2010 Global life science conference call, Jun. 8, 2010, Published on Jun. 8, 2010[online]Retrieved from:<URL:wsw.com/webcast/jeff46/hzym/ [7 pages].
Halozyme Therapeutics, Jefferies Investor Presentation "Matrix Therapies for Life," New York, Ny., Jun. 17, 2009. Oral Presentation, 30 pp.
Infante et al., "Targeting hyaluronan (Ha) in tumor (T) stroma. Interim safety and translational evaluation of pegylated hyaluronidase (PEGPH2O, P) in patients (Pts) with advanced solid tumors — a focus on Gi malignancies," 2012 Gastrointestinal Cancers Symposium, Jan. 19-21, 2012, San Francisco, Ca. Abstract No. 249, available on-line 1/12/12, 3 pp.
Jiang et al "PEGPH2O: PEGylated recombinant human hyaluronidase antitumor activity in the 4T1 orthotopic breast carcinoma model" 2009 Aacr Apr. 9 2009. Abstract, 1 page.
Jiang et al "PEGPH2O: PEGylated recombinant human hyaluronidase antitumor activity in the 4T1 orthotopic breast carcinoma model" 2009 Aacr Apr. 9 2009. Poster, 1 p.
Jiang et al., "Effects of Recombinant Human PH2O (rHuPH20) on Interstitial Matrices: Creating a Favorable Environment for the Delivery of Cytostatic Agents," [abstract]. In: Proceedings of the 96th Annual Meeting of the American Association for Cancer Research; 2005 Apr 16-20; Anaheim, Ca.:Aacr; 2005. vol. 46, p. 1198, Abstract No. 5075, Apr. 2005.
Jiang et al., "Hyaluronan (Ha) accumulation in tumors correlates with response to pegylated rHuPH20 hyaluronidase (PEGPH2O) in human tumors: a biomarker strategy," American Association for Cancer Research (Aacr-Eortc) Annual Meeting, San Francisco, Ca. Presented Nov. 14, 2011. Poster board No. B35, 1 p.
Jiang et al., "Hyaluronan (Ha) accumulation in tumors correlates with response to pegylated rHuPH20 hyaluronidase (PEGPH2O) in human tumors: a biomarker strategy," American Association for Cancer Research (Aacr-Eortc) Annual Meeting, San Francisco, Ca. Published on-line Nov. 12, 2011. Abstract No. B35, 2 pp.
Jiang et al., "Reduction of ischemic stroke mortality with chronic intravenous recombinant human hyaluronidase (rHuPH20): effects of pharmacokinetic optimization," American Neurological Association Annual Meeting, Sep. 25-28, 2005, San Diego, CA, 2 pages.
Jiang et al., "Safety and activity of rHuPH20 hyaluronidase co-administration with mitomycin in the treatment of superficial transitional bladder carcinoma," American Association for Cancer Research Annual Meeting, 2006, Washington, DC, 06-LBA-8826-AACR. Abstract, 2 pages.
Jiang et al., "Safety and activity of rHuPH20 hyaluronidase co-administration with mitomycin in the treatment of superficial transitional bladder carcinoma," American Association for Cancer Research Annual Meeting, 2006, Washington, DC, 06-LBA-8826-AACR. Poster, 1 page.
Jiang et al., "A comparative study of hyaluronan in tumors derived from BBN induced rat bladder carcinomas and human bladder TCC," Hyaluronan (ISHAS) 2007, Charleston, SC., Presentation, 15 pages.
Kadhim et al., "Antitumor activity of pegylated recombinant human hyaluronidase (PEGPH20) in xenograft and syngeneic Rat MatLyLu prostate carcinoma models," AACR Meeting, Apr. 19, 2009 Abstract # 260, [accessed on-line Apr. 3, 2009], 2 pages.
Kadhim et al., "Antitumor activity of pegylated recombinant human hyaluronidase (PEGPH20) in xenograft and syngeneic Rat MatLyLu prostate carcinoma models," AACR Meeting, Apr. 19, 2009, Denver, CO., Poster #260, 1 page.
Kadhim et al., " PEGPH20: PEGylated Human Recombinant PH20 Hyaluronidase Shows Significant Antitumor Activity Concomitant with Hyaluronan Reduction in the PC3 Hormone Refractory Prostate Cancer Model" AACR 2009. Poster #8569, 1page.
Kadhim et al., "Synergistic anti-tumor effects of pegylated recombinant human hyaluronidase (PEGPH20) with Gemcitabine in subcutaneous pancreatic cancer xenograft models." AACR 101st Annual Meeting, Washington D.C., Apr. 21, 2010. Abstract #5392, 1 page.
Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008. Abstract #A45, 1 page.
Kadhim et al., "Synergistic anti-tumor effect of pegylated recombinant human hyaluronidase.(PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008. Poster #A45, 1 page.
Kang et al., "Use of a recombinant human enzyme for enhanced local adenovirus mediated gene delivery," American Association of Pharmaceutical Scientists Annual Meeting, Nov. 7-9, 2005, Nashville, TN. Abstract, 1 page.
Kang et al., "Use of a recombinant human enzyme for enhanced local adenovirus mediated gene delivery," American Association of Pharmaceutical Scientists Annual Meeting, Nov. 7-9, 2005, Nashville, TN. Poster, 1 page.
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Abstract, 1 page.
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Poster, 1 page.
Li et al, "PEGylated human recombinant hyaluronidase (PEGPH20) removes peritumoral hyaluronan and increases the efficacy of chemotherapy and radiotherapy in an experimental brain metastisis model," 2009 ASCR, Apr. 19, 2009. Abstract #262, 2 pages.
Lim et al., "Matrix Therapies for life," 28th Annual JP Morgan Healthcare Conference San Francisco, CA., Jan. 13, 2010. Oral Presentation, 42 pages.
Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012, Abstract #5635, Available on-line Mar. 2012, 1 page.
Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012. Chicago, IL, Presented Apr. 4, 2012. Poster #5635, 1 page.
Pinkstaff et al., (says Pinkstaff first) "Reduction of Ischemic Stroke Mortality Following Intravenous Recombinant Human Hyaluronidase (rHuPH20): Effects of Pharmacokinetic Optimization," American Neurological Association, Sep. 25-28, 2005, San Diego, CA, Poster, 5 pages.
Pinkstaff et al., "Evaluation of the Compatibility and Pharmacokinetics of Co-formulated Biologics with Recombinant Human

(56) References Cited

OTHER PUBLICATIONS

Hyaluronidase: Dose Response," American Association of Pharmaceutical Scientists Conference, Jun. 2006, San Antonio, TX. Abstract, 1 page.
Pinkstaff et al., "Evaluation of the Compatibility and Pharmacokinetics of Co-formulated Biologics with Recombinant Human Hyaluronidase: Dose Response," American Association of Pharmaceutical Scientists Conference, Jun. 2006, San Antonio, TX. Poster, 2 pages.
Pinkstaff et al., "Recombinant Human Hyaluronidase for Drug and Fluid Dispersion," American Association of Pharmaceutical Scientists Annual Meeting, Nov. 2006, Boston, MA, Abstract, 1 page.
Pinkstaff et al., "Recombinant Human Hyaluronidase for Drug and Fluid Dispersion," American Association of Pharmaceutical Scientists Annual Meeting, Nov. 2006, Boston, MA, Poster, 1 page.
Pinkstaff et al., "Recombinant Human Hyaluronidase for Use with Therapeutic Antibodies," Controlled Release Society Conference, Vienna, Austria, 2006. Abstract, 1 page.
Pinkstaff et al., "Recombinant Human Hyaluronidase for Use with Therapeutic Antibodies," Controlled Release Society Conference, Vienna, Austria, 2006. Poster, 1 page.
Ramanathan et al., "Targeting hyaluronan in tumor stroma: Interim translational & biomarker evaluations of pegylated hyaluronidase (PEGPH20) in animal models & patients with advanced solid tumors," European Organisation for Research and Treatment of Cancer-National Cancer Institute—American Society of Clinical OFncology (EORTC-NCI-ASCO) Annual Meeting on "Molecular Markers in Cancer", Oct. 27-29, 2011, Brussels, Belgium, Poster, 1 page.
Shepard et al., "Targeting hyaluronan (HA) in the tumor stroma. Translational evaluation of pegylated hyaluronidase (PEGPH20) in animal models and patients with advanced solid tumors" EORTC-ASCO-NCI meeting Hollywood Florida, Oct. 19, 2010.
Shepard et al:,"Hyaluronan: The Glue that Holds a Tumor Together" Biotherapeutic Targets, Boston, MA, May 21, 2010. Oral presentation, 26 pages.
Shepard, M., "PEGPH20—A Targeted Therapy for Cancer Treatment" presented at Target Discovery World Congress, South San Francisco Aug. 4-5, 2009. Oral presentation, 13 pages.
Singha et al., "Enzymatic depletion of pericellular HA sensitize antibody dependent cell-mediated cytotoxicity" presented at AACR Apr. 2011 Abstract (published Mar. 2011), 2 pages.
Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, 2008, San Diego, CA. Abstract, 1 page.
Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, Apr. 12-16, 2008, San Diego, CA. Poster, 4 pages.
Wei et al., "Functions of N-linked glycans on human hyaluronidase PH20," poster 83, Presented at San Diego Glycobiology Symposium 2009, 1 page.
Wei et al., "Structure function analysis of the human hyaluronidase enzymes," Presented at American Society for Matrix Biology Biennial Meeting, San Diego, CA, Dec. 9, 2008, Poster B4, 1 page.
Whatcott et al., "Hyaluronan deposition correlates with poor survival in pancreatic cancer." American Association of Cancer Research Annual Meeting, Orlando, FL Apr. 5, 2011. Abstract, 1 page.
Wilson MS, "Enhanze Technology—An Enzymatic Drug Delivery System (DDS)," Japanese Export Trade Organization, Nov. 2005, Santa Clara, CA. Oral presentation, 22 pages.
Oncology—Halozyme Therapeutics, [online][retrieved on Jan. 21, 2010] Retrieved from:<URL:halozyme.com/products_oncology.php [2 pages].
Halozyme Website, "Products & pipeline-PEGPH20," [online][retrieved on Nov. 17, 2011] Retrieved from:<URL:halozyme.com/Products-And-Pipeline/Pipeline/PEGPH20/default.aspx [2 pages].
Halozyme Therapeutics Investor Presentation, "Company Overview," Feb. 1, 2006, 34 pages.
Halozyme Therapeutics Investor Presentation, "Company Overview," Feb. 12, 2008, 37 pages.
Halozyme Therapeutics Investor Presentation, "Company Overview," Feb. 22, 2007, 25 pages.
Halozyme Therapeutics, "Halozyme Therapeutic, Inc. Prospectus Supplement," Jun. 23, 2009, 85 pages.
Halozyme Therapeutics, "Exclusive Distribution Agreement," Aug. 13, 2004, 13 pages.
Halozyme Therapeutics, Securities and Exchange Commission form 10K, Mar. 11, 2011, 124 pages.
Halozyme Therapeutics, Securities and Exchange Commission Form 8-K, Jan. 10, 2011, 43 pages.
News release, "Halozyme studies target hyaluronan surrounding solid tumors, May offer new approach to cancer treatment," Published on Apr. 20, 2009 [online][retrieved on Jun. 23, 2009], Retrieved from:<URL:aim168realestate.com/real-estate-news/united-states-of-america/20155/halozyme [4 pages].
News release, "Halozyme therapeutics presents positive pre-clinical single agent data for PEGPH20," Published on Jan. 26, 2009 [online][retrieved on Jul. 16, 2009], Retrieved from: <URL: pluc.corporate-ir.net/phoenix.zhtml?c=175436&p=irol-newsArticle_print&ID=1248119&highlight= [2 pages].
News Release, Halozyme Therapeutics, Inc., "Halozyme announces Roche completes patient enrollment in phase 3 clinical trial with subcutaneous Herceptin®," Published on Dec. 7, 2010[online] [retrieved on Jan. 26, 2011] Retrieved from:<URL:phx.corporate-ir.net/phoenix.zhtml?c=175436&p=irol-newsArticle&ID=1505172 &highlight= [2 pages].
News Release, Halozyme Therapeutics, Inc., Halozyme therapeutics announces positive findings with pegylated enzyme in prostate cancer models, Published on Jul. 22, 2008[online][retrieved on Dec. 29, 2009] Retrieved from:<URL: drugs.com/clinical_trials/halozyme-therapeuties-announces-positive-findings-pegylated-enzyme-prostate-cancer-models-5142.html [3 pages].
News Release, Halozyme Therapeutics, Inc., "Halozyme therapeutics presents pre-clinical studies with systemic delivery of pegylated rHuPH20 enzyme in prostate cancer models at American Association for Cancer Research," Published on Apr. 15, 2008[online][retrieved on Jul. 16, 2009] Retrieved from:<URL:halozyme.com/Investors/News-Releases/News-Release-Details/2008/Halozyme-Therapeutics-Presents-Pre-Clinical-Studies-of-Systemic-Delivery-of-Pegylated-rHuPH20-Enyzme-in-Prostate-Cancer-Model/defaultaspx [3 pages].
News Release, Halozyme Therapeutics, Inc., "Halozyme therapeutics, inc. begins phase 1 clinical study with PEGPH20 in cancer patients with refractory solid tumors," Published on Mar. 31, 2009[online][retrieved on Apr. 27, 2010] Retrieved from:<URL:in.reuters.com/money/quotes/keyDevelopments?symbol=HALO.O [1 page].
News Release, Halozyme Therapeutics, Inc., "Halozyme and Baxter announce availability of hylenex for subcutaneous delivery of medications and fluids," Published on Jun. 27, 2006[online][retrieved on Jan. 6, 2009] Retrieved from:<URL:phx.corporate-ir.net/phoenix.zhtml?c=175436&p=irol-newsArticle_Print&ID=876530 &highlight= [3 pages].
News Release, Halozyme Therapeutics, Inc., "Halozyme Therapeutics announces submission of investigational new drug application for chemophase," Published on Jun. 30, 2005[online][retrieved on Jan. 6, 2009] Retrieved from:<URL:phx.corporate-ir.net/phoenix.zhtml?c=175436&p=irol-newsArticle_Print&ID=725295 &highlight= [2 pages].
News Release, Halozyme Therapeutics, Inc., "Halozyme Therapeutics announces that chemophase meets primary endpoint in phase I/IIa clinical trial," Published on Jun. 30, 2008[online][retrieved on Jan. 6, 2009] Retrieved from:<URL:phx.corporate-ir.net/phoenix.zhtml?c=175436&p=irol-newsArticle_Print&ID=1170737 &highlight= [3 pages].
News Release, Halozyme Therapeutics, Inc., "Halozyme Therapeutics completes enrollment in chemophase phase I/IIa clinical trial for superficial bladder cancer," Published on Sep. 25, 2007[online][retrieved on Jan. 6, 2009] Retrieved from:<URL:phx.

(56) References Cited

OTHER PUBLICATIONS corporate-ir.net/phoenix.zhtml?c=175436&p=irol-newsArticle_Print&ID=1055493&highlight= [2 pages].

News Release, Halozyme Therapeutics, Inc., "Halozyme Therapeutics completes enrollment in chemophase phase I clinical trial for superficial bladder cancer," Published on Mar. 6, 2006[online][retrieved on Jan. 6, 2009] Retrieved from:<URL:phx.corporate-ir.net/phoenix.zhtml?c=175436&p=irol-newsArticle Print&ID=827129&highlight= [2 pages].

News Release, Halozyme Therapeutics, Inc., "Halozyme Therapeutics completes enrollment of enhanze technology clinical trial to improve the subcutaneous absorption of a large protein molecule therapeutic," Published on Nov. 27, 2006[online][retrieved on Jan. 6, 2009] Retrieved from:<URL:phx.corporate-ir.net/phoenix.zhtml?c=175436&p=irol-newsArticle_Print&ID=935824&highlight= [2 pages].

News Release, Halozyme Therapeutics, Inc., "Halozyme therapeutics files NDA for Enhanze SC," Published on Mar. 28, 2005[online][retrieved on Jan. 6, 2009] Retrieved from:<URL:phx.corporate-ir.net/phoenix.zhtml?c=175436&p=irol-newsArticle_Print&ID=689194&highlight= [2 pages].

News Release, Halozyme Therapeutics, Inc., "Halozyme Therapeutics initiates chemophase phase I clinical trial for superficial bladder cancer—first patients treated," Published on Oct. 27, 2005[online][retrieved on Jan. 6, 2009] Retrieved from:<URL:phx.corporate-ir.net/phoenix.zhtml?c=175436&p=irol-newsArticle_Print&ID=774533&highlight= [2 pages].

News Release, Halozyme Therapeutics, Inc., "Halozyme Therapeutics completes enrollment in chemophase phase I/IIa clinical trial for superficial bladder cancer," Published on Apr. 26, 2006[online][retrieved on Jan. 6, 2009] Retrieved from:<URL:phx.corporate-ir.net/phoenix.zhtml?c=175436&p=irol-newsArticle_Print&Id=847794&highlight= [2 pages].

News Release, Halozyme Therapeutics, Inc., "Halozyme Therapeutics initiates first enhanze technology clinical trial to improve the subcutaneous absorption of a large molecule protein therapeutic," Published on Aug. 8, 2006[online][retrieved on Jan. 6, 2009] Retrieved from:<URL:phx.corporate-ir.net/phoenix.zhtml?c=175436&p=irol-newsArticle_Print&ID=893361&highlight= [2 pages].

News Release, Halozyme Therapeutics, Inc., "Halozyme Therapeutics receives FDA clearance to initiate chemophase clinical trial," Published on Aug. 11, 2005[online][retrieved on Jan. 6, 2009] Retrieved from:<URL:phx.corporate-ir.net/phoenix.zhtml?c=175436&p=irol- newsArticle_Print&ID=742261&highlight= [2 pages].

News Release, Halozyme Therapeutics, Inc., "Halozyme Therapeutics releases results of enhanze technology clinical trial to improve the subcutaneous absorption of a large protein molecule therapeutic," Published on Jan. 22, 2007[online][retrieved on Jan. 6, 2009] Retrieved from:<URL:phx.corporate-ir.net/phoenix.zhtml?c=175436&p=irol-newsArticle_Print&ID=952285&highlight= [3 pages].

News Release, Halozyme Therapeutics, Inc., "Halozyme Therapeutics announces data from two phase 1 studies of PEGPH20 demonstrating targeting of hyaluronan in tumor stroma," Published on Oct. 27, 2011 [online] [retrieved on Nov. 17, 2011] Retrieved from:<URL: halozyme.com/Investors/News-Releases/News-Release-Details/2011/Halozyme-Therapeutics-Announces-Data-From-Two-Phase-I-Studies-of-PEGPH20-Demonstrating-Targeting-of-Hyaluronan-in-Tumor-Strom/default.aspx [1 page].

International Search Report and Written Opinion, dated Nov. 16, 2009, in connection with International Patent Application No. PCT/US2009/002352, 18 pages.

Response of Feb. 16, 2010 to Written Opinion, dated Nov. 16, 2009, for International Patent Application No. PCT/US2009/002352, 25 pages.

International Preliminary Report on Patentability, dated Jul. 15, 2010, in connectio with International Patent Application No. PCT/US2009/002352, 22 pages.

Examination Report, dated Mar. 30, 2011, in connection with corresponding New Zealand Applicantion No. 588638, 2 pages.

Restriction Requirement, dated Apr. 27, 2011, in connection with U.S. Appl. No. 12/386,222, 13 pages.

Response dated Jul. 27, 2011 to Restriction Requirement, dated Apr. 27, 2011, in connection with U.S. Appl. No. 12/386,222, 21 pages.

Interview Summary, dated Aug. 15, 2011, in connection with U.S. Appl. No. 12/386,222, 4 pages.

Office Action, dated Aug. 24, 2011, in connection with U.S. Appl. No. 12/386,222, 18 pages.

Office Action, dated Oct. 11, 2011, in connection with U.S. Appl. No. 12/386,273, 12 pages.

International Search Report and Written Opinion, dated Jan. 25, 2012, in connection with International Application No. PCT/US2011/044281, 26 pages.

U.S. Appl. No. 13/694,071, filed Oct. 24, 2012, 2013-0202583, Aug. 8, 2013.

U.S. Appl. No. 13/815,311, filed Feb. 19, 2013, 2013-0251786, Sep. 26, 2013.

U.S. Appl. No. 13/815,804, filed Mar. 15, 2013.

U.S. Appl. No. 13/998,040, filed Sep. 24, 2013.

U.S. Appl. No. 13/998,058, filed Sep. 25, 2013.

Letter/Written Disclosure of the Supplemental Information Disclosure Statement for the above-referenced application, dated Oct. 23, 2013, 2 pages.

Hingorani et al., "A phase Ib study of gemcitabine plus PEGPH20 (pegylated recombinant human hyaluronidase) in patients with stage IV previously untreated pancreatic cancer," 2013 ASCO Annual Meeting, Chicago, IL, Poster #4010, 1 page.

News Release, "Halozyme's phase 1b clinical trial of PEGPH20 with Gemcitabine indicates positive activity against pancreatic cancer," Published on-line Jun. 3, 2013 and Retrieved from:<URL:firstwordpharma.com/node/1098370?tsid=4 (accessed Jun. 12, 2013), 3 pages.

News Release, "Halozyme begins randomized, controlled clinical trial with PEGPH20 in patients with advanced pancreatic cancer," Published Oct. 5, 2011 [online][Retrieved May 30, 2013][Retrieved from:<URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx, 3 pages.

Office Action, dated May 23, 2013, in connection with U.S. Appl. No. 13/506,783, 16 pages.

Response, dated Jun. 7, 2013, to Examiner's Report, dated Nov. 7, 2012, in connection with Canadian Patent Application No. 2,721,229, 53 pages.

Office Action, dated Jul. 8, 2013 (received Sep. 23, 2013), in connection with in connection with Chinese Patent Application No. 200980122359.3 [English Translation], 7 pages.

Extended European Search Report and Search Opinion, dated Oct. 10, 2013, in connection with European Patent Application No. 13178038.9, 9 pages.

Letter/Written Disclosure of the Supplemental Information Disclosure Statement for the above-referenced application, dated Jan. 16, 2014, 2 pages.

Office Action, dated Nov. 29, 2013 (dated Dec. 17, 2013), in connection with corresponding Korean Patent Application No. 10-2010-7025485 [English Translation], 8 pages.

U.S. Appl. No. 13/506,783, filed May 16, 2012, 2012-0251620, Oct. 4, 2012.

U.S. Appl. No. 13/506,844, filed May 18, 2012, 2012-0251517, Oct. 4, 2012.

U.S. Appl. No. 13/507,263, filed Jun. 15, 2012, 2013-0011378, Jan. 10, 2013.

U.S. Appl. No. 13/507,262, filed Jun. 15, 2012, 2013-0022588, Jan. 24, 2013.

U.S. Appl. No. 13/507,261, filed Jun. 15, 2012, 2013-0022592, Jan. 24, 2013.

U.S. Appl. No. 13/507,540, filed Jul. 6, 2012, 2012-0294830, Nov. 22, 2012.

U.S. Appl. No. 13/694,005, filed Oct. 18, 2012, 2013-0058893, Mar. 7, 2013.

U.S. Appl. No. 13/694,071, filed Oct. 24, 2012.

U.S. Appl. No. 13/684,731, filed Dec. 28, 2012.

U.S. Appl. No. 13/815,311, filed Feb. 19, 2013.

(56) References Cited

OTHER PUBLICATIONS

U.S. Appl. No. 13/815,553, filed Mar. 8, 2013.
Letter/Written Disclosure of the Supplemental Information Disclosure Statement for the above-referenced application, dated Apr. 4, 2013, 2 pages.
ClinicalTrials.gov, "Study of Gemcitabine + PEGPH20 vs Gemcitabine Alone in Stage IV Previously Untreated Pancreatic Cancer," ClinicalTrials.gov identifier: NCT01453153; study first received: Oct. 13, 2011; last updated: Oct. 17, 2012. [retrieved on Feb. 15, 2013] Retrieved from the Internet<URL:clinicaltrials.gov/ct2/show?term=PEGPH20&rank=3, 4 pages.
Jacobetz et al., "Hyaluronan impairs vascular function and drug delivery in a mouse model of pancreatic cancer," Gut. 62(1):112-120 (2013).
Jiang et al., "Effective targeting of the tumor microenvironment for cancer therapy," Anticancer Research 32:1203-1212 (2012).
Kultti et al., "Therapeutic targeting of hyaluronan in the tumor stroma," Cancers. 4(3):873-903 (2012).
Provenzano et al., "Enzymatic targeting of the stroma ablates physical barriers to treatment of pancreatic ductal adenocarcinoma," Cancer Cell. 21(3):418-429 (2012).
Toole et al., "Hyaluronan-cell interactions in cancer and vascular disease," J Biol Chem. 277(7):4593-4596 (2001). Epub date Nov. 20, 2001.
Frost, G., "Halozyme Therapeutics, Inc. Thinking outside the cell," presented at J. P. Morgan Healthcare Conference on Jan. 10, 2013. Presentation. 23 pages.
Halozyme Therapeutics, J.P. Morgan Annual Healthcare Conference Presentation, Jan. 2013. Presentation, 18 pages.
Thompson et al., "Pegylated recombinant human hyaluronidase PH20 (PEGPH20) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Abstract, 1 page.
Thompson et al., "Pegylated recombinant human hyaluronidase PH20 (PEGPH20) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Poster #73, 1 page.
Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].
News Release, "Halozyme therapeutics and Pfizer enter into a collaboration to develop and commercialize subcutaneous biologics using recombinant human hyaluronidase," Published on Dec. 21, 2012 [online] [Retrieved on Jan. 3, 2013] Retrieved from the Internet: URL:halozyme.com/Investors/News-Releases/News-Release-Details/2012/Halozyme-Therapeutics-And-Pfizer-Enter-Into-A-Collaboration-To-Develop-And-Commercialize-Subcutaneous-Biologics-Using-Recombi/default.aspx, 1 page.
Transcript, "Halozyme Therapeutics's CEO hosts analyst/investor day conference call (transcript)," Published on Oct. 2, 2012 [online] [Retrieved on Oct. 25, 2012] Retrieved from the Internet: URL:http://seekingalpha.com/article/901141-halozyme-therapeutics-s-ceo-hosts-analyst-investor-day-conference-call-transcript?part=single [26 pages].
News Release, "Halozyme Therapeutics to present at the 31st annual J.P. Morgan Healthcare Conference," Published Jan. 3, 2013 [online][Retrieved Jan. 17, 2013][Retrieved from the Internet: URL:http://www.halozyme.com/Investors/News-Releases/News-Release-Details/2013/Halozyme-Therapeutics-to-Present-at-the-31st-Annual-JP-Morgan-Healthcare-Conference1132508/default.aspx, 1 page.
Response to Examination report, dated May 2, 2012, in connection with Australian Patent Application No. 2009236635, 19 pages.
Office Action, dated Jul. 4, 2012, in connection with Israeli Patent Application No. 208518, 4 pages.
Office Action and Search Report, dated Aug. 17, 2012, in connection with Chinese Patent Application No. 200980122359.3, 6 pages.

Instructions for Response to Office Action, dated Aug. 17, 2012, in connection with Chinese Patent Application No. 200980122359.3, 22 pages.
Examiner's Report, dated Nov. 7, 2012, in connection with Canadian Patent Application No. 2,721,229, 5 pages.
Examination Report, dated Jan. 16, 2013, in connection with European Patent Application No. 09732255.6, 3 pages.
Office Action, dated Feb. 26, 2013, in connection with Japanese Patent Application No. 2011-505021[English translation together with original document in the Japanese language], 14 pages.
Letter/Written Disclosure of the Supplemental Information Disclosure Statement for the above-referenced application, mailed the same day herewith, 2 pages.
Halozyme Therapeutics, "Hylenex(R) recombinant (hyaluronidase human injection) and infiltration and extravasion," Revised on Aug. 2011 [online][retrieved on Apr. 3, 2013] Retrieved from:<URL:hylenex.com/files/resources_docs/Infiltration-Extravasation/documentation/Hylenex%20recombinant%20and%20Infiltration-Extravasation.pdf , 7 pages.
Halozyme, Inc. Information and Consent Form, "A phase 2, randomized, multicenter study of PEGPH20 (PEGylated Recombinant Human Hyaluronidase) combined with nab-paclitaxel plus gemcitabine compared with nab-paclitaxel plus gemcitabine in subjects with stage IV previously untreated pancreatic cancer," Study # HALO-109-202, 1 page.
Harris et al., "Pharmacokinetic (PK)/pharmacodynamic (PD) results from a phase Ib study of pegylated hyaluronidase PH20 (PEGPH20) in combination with gemcitabine (Gem) in patients with pancreatic cancer," 2013 ASCO Annual Meeting, J Clin Oncol 31, 2013 (suppl; abstr e15005) Epub date May 15, 2013, 3 pages.
Hingorani et al., "A phase Ib study of gemcitabine plus PEGPH20 (pegylated recombinant human hyaluronidase) in patients with stage IV previously untreated pancreatic cancer," 2013 ASCO Annual Meeting, J Clin Oncol 31, 2013 (suppl; abstr 4010) Epub date May 15, 2013, 3 pages.
Jiang et al., "Phase I pharmacodyamic activity of multiple-dose PEGylated hyaluronidase PH20 (PEGPH20) in patients with solid tumors," AACR Annual Meeting 2013, Apr. 6-10, 2013, Washington, D.C., Abstract 3375, [Retrieved from the interne Apr. 5, 2013], 1 page.
Jiang et al., Jiang et al., "Phase 1 pharmacodyamic activity of multiple-dose PEGylated hyaluronidase PH20 (PEGPH20) in patients with solid tumors," AACR Annual Meeting 2013 Apr. 6-10, 2013, Washington, D.C., Poster 3375, 1 page.
Osgood et al., "Pegylated recombinant human hyaluronidase PH20 (PEGPH20) enhances Nab-Paclitaxel efficacy in BxPC-3 human pancreatic cancer xenografts," Cancer Research 72(8):Suppl 1, Abstract 5635 (2012), 2 pages.
Singha et al., "Hyaluronan-rich ECM contributes to resistance to antibody-dependent cell-mediated cytotoxicity in solid tumors," AACR Annual Meeting 2013 Apr. 6-10, 2013, Washington, D.C., Abstract #4999 [Retrieved from the internet Apr. 5, 2013], 1 page.
Singha et al., "Hyaluronan-rich ECM contributes to resistance to antibody-dependent cell-mediated cytotoxicity in solid tumors," AACR Annual Meeting 2013 Apr. 6-10, 2013, Washington, D.C., Poster #4999, 1 page.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Abstract #4955 [Retrieved from the interne Apr. 5, 2013], 1 page.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Poster #4955, 1 page.
News Release, Halozyme Therapeutics Inc. Q4 2007 Earnings Call Transcript, Published on Mar. 14, 2008 [online][retrieved on Jun. 24, 2009] Retrieved from:<URL:seekingalpha.com/article/68609-halozyme-therapeutics-q4-2007-earnings-call-transcript, 12 pages.
News Release, "Halozyme initiates randomized phase 2 trial of PEGPH20 in pancreatic cancer," Published on Apr. 23, 2013 [online][retrieved on May 16, 2013] Retrieved from:<URL:halozyme.

(56) References Cited

OTHER PUBLICATIONS com/Investors/News-Releases/News-Release-Details/2013/Halozyme-Initiates-Randomized-Phase-2-Trial-of-PEGPH20-in-Pancreatic-Cancer/default.aspx, 3 pages.
News Release, "Halozyme to present new data on PEGPH20 in pancreatic cancer at American Society of Clinical Oncology Annual Meeting," Published on May 15, 2013 [online][retrieved on May 16, 2013] Retrieved from:<URL:halozyme.com/Investors/News-Releases/News-Release-Details/2013/Halozyme-To-Present-New-Data-On-PEGPH20-In-Pancreatic-Cancer-At-American-Society-of-Clinical-Oncology-Annual-Meeting/default.aspx, 3 pages.
Examination Report, dated Mar. 1, 2013, in connection with Australian Patent Application No. 2009236635, 4 pages.
Response to Office Action, dated Jul. 4, 2012, in connection with Israeli Patent Application No. 208518, 6 pages.
Office Action, dated Apr. 19, 2013, in connection with Korean Patent Application No. 10-2010-7025485 [English Translation], 7 pages.
U.S. Appl. No. 13/694,731, filed Dec. 28, 2012.
U.S. Appl. No. 13/374,500, filed Dec. 28, 2011, 2012-0148555, Jun. 14, 2012.
U.S. Appl. No. 13/385,527, filed Feb. 21, 2012, 2012-0213767, Aug. 23, 2012.
U.S. Appl. No. 13/385,919, filed Mar. 13, 2012, 2012-0196348, Aug. 2, 2012.
U.S. Appl. No. 13/506,783, filed May 16, 2012.
U.S. Appl. No. 13/506,844, filed May 18, 2012.
U.S. Appl. No. 13/507,263, filed Jun. 15, 2012.
U.S. Appl. No. 13/507,262, filed Jun. 15, 2012.
U.S. Appl. No. 13/507,261, filed Jun. 15, 2012.
U.S. Appl. No. 13/507,540, filed Jul. 6, 2012.
Letter/Written Disclosure of the Supplemental Information Disclosure Statement for the above-referenced application, dated Sep. 19, 2012 2 pages.
Nykopp et al., "Expression of hyaluronan synthases (HAS1-3) and hyaluronidases (HYAL1-2) in serous ovarian carcinomas: inverse correlation between Hyal1 and hyaluronan content," BMC Cancer. 9:143, 9 pages (2009).
Borad et al., "Targeting hyaluronan (HA) in tumor stroma: a phase I study to evaluate the safety, pharmacokinetics (PK), and pharmacodynamics (PD) of pegylated hyaluronidase (PEGPH20) in patients with solid tumors," 2012 ASCO Annual Meeting, Jun. 1-5, 2012 Chicago, IL. Abstract 2579. [Released on-line May 16, 2012], 3 pages.
Borad et al., "Targeting hyaluronan (HA) in tumor stroma: a phase I study to evaluate the safety, pharmacokinetics (PK), and pharmacodynamics (PD) of pegylated hyaluronidase (PEGPH20) in patients with solid tumors ," 2012 ASCO Annual Meeting, Jun. 1-5, 2012 Chicago, IL. Poster 2579, 1 page.
Kozak et al., "Recombinant human hyaluronidase facilitates dexamethasone penetration into the posterior ocular segment after sub-Tenon's injection," Association for Research in Vision and Ophthalmology Annual Meeting, May 1-5, 2005, Fort Lauderdale, FL. Poster, 1 page.
Li et al., "Pegylated human recombinant hyaluronidase PH20 reduces solid tumor hypoxia," AACR Annual Meeting 2012. Available on-line Mar. 2012. [Retrieved from the internet Apr. 17, 2012], Abstract #3796, 1 page.
Maneval et al., "Phase 1 pharmacokinetics (PK) & pharmacodynamics (PD) of PEGylated hyaluronidase PH20 (PEGPH2O) in patients with solid tumors," AACR Annual Meeting 2012. Available on-line Mar. 2012. [Retrieved from the internet Apr. 17, 2012], Abstract #3796, 1 page.
Sadeghi et al., "Effect of hydrophilic components of the extracellular matrix on quantifiable diffusion-weighted imaging of human gliomas: preliminary results of correlating apparent diffusion coefficient values and hyaluronan expression level," AJR Am J Roentgenol. 181(1):235-241 (2003).
Singha et al., "PEGPH20 depletion of pericellular hyaluronan sensitizes high hyaluronan-producing tumor cells in antibody-dependent cell-mediated cytotoxicity," presented at AACR Special Conference: "Molecularly Targeted Therapies: Mechanisms of Resistance" May 9-12, San Diego, CA. Abstract, 1 page.
News Release, Halozyme Therapeutics, Inc., "PEGPH20 enzyme re-expands insides of blood vessels to allow more drugs to reach tumours," Published on Mar. 21, 2012 [online][retrieved on Aug. 7, 2012] Retrieved from:<URL:news-medical.net/news/20120321/PEGPH20-enzyme-re-expands-insides-of-blood-vessels-to-allow-more-drugs-to-reach-tumours.aspx [1 page].
Response to Office Action, dated Oct. 11, 2011, in connection with related U.S. Appl. No. 12/386,473, 19 pages.
Examination report, dated May 2, 2012, in connection with corresponding Australian Patent Application No. 2009236635, 3 pages.
Response to Written Opinion, dated Jan. 25, 2012, in connection with related International Application No. PCT/US2011/044281, 53 pages.
Response to Examination Report, dated Mar. 30, 2011, in connection with corresponding New Zealand Application No. 588638, 21 pages.
Examination Report, dated Jul. 18, 2012 in connection with corresponding New Zealand Patent Application No. 601248, 2 pages.
Notice of Acceptance, dated Aug. 27, 2012, in connection with corresponding New Zealand Patent Application No. 588638, 1 page.
Search Report and Written Opinion, dated Aug. 2, 2012, in connection with corresponding Singaporean Patent Application No. 201007482-1, 15 pages.
U.S. Appl. No. 13/815,804, filed Mar. 15, 2013, 2013-0302400, Nov. 14, 2013.
Letter/Written Disclosure of the Supplemental Information Disclosure Statement for the above-referenced application, dated Jan. 6, 2014, 2 pages.
News Release, "Halozyme's phase lb clinical trial of PEGPH20 with Gemcitabine indicates positive activity against pancreatic cancer," Published on-line Jun. 3, 2013 and Retrieved from:<URL:firstwordpharma.com/node/1098370?tsid=4 (accessed Jan. 3, 2014), 1 page.
News Release, "Halozyme Begins Randomized, Controlled Clinical Trial with PEGPH20 in Patients with Advanced Pancreatic Cancer," Published Oct. 5, 2011 [online][Retrieved Jan. 1, 2014][located at <URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx], 2 pages.
Office Action, dated May 23, 2013, in connection with related U.S. Appl. No. 13/506,783, 16 pages.
Response, dated Nov. 14, 2013, to Examination Report, dated Jul. 18, 2012 in connection with corresponding Australian Patent Application No. 601248, 7 pages.
Examination Report, dated Nov. 22, 2013, in connection with corresponding New Zealand Patent Application No. 601248, 2 pages.
Response, dated Jun. 7, 2013, to Examiner's Report, dated Nov. 7, 2012, in connection with corresponding Canadian Patent Application No. 2,721,229, 53 pages.
Office Action, dated Jul. 8, 2013 (dated Sep. 23, 2013), in connection with in connection with corresponding Chinese Patent Application No. 200980122359.3 [English Translation], 7 pages.
Extended European Search Report and Search Opinion, dated Oct. 10, 2013, in connection with corresponding European Patent Application No. 13178038.9, 9 pages.
U.S. Appl. No. 13/999,454, filed Feb. 26, 2014, 2014-0199282, Jul. 17, 2014.
U.S. Appl. No. 14/120,224, filed May 7, 2014.
U.S. Appl. No. 14/323,932, filed Jul. 3, 2014.
U.S. Appl. No. 14/459,876, filed Aug. 14, 2014.
Letter/Written Disclosure of the Supplemental Information Disclosure Statement for the above-referenced application, dated Sep. 19, 2014, 2 pages.
Hiltunen et al., "Elevated hyaluronan concentration without hyaluronidase activation in malignant epithelial ovarian tumors," Cancer Res. 62(22):6410-6413 (2002).

(56) References Cited

OTHER PUBLICATIONS

Kultti et al., "Accumulation of Extracellular Hyaluronan by Hyaluronan Synthase 3 Promotes Tumor Growth and Modulates the Pancreatic Cancer Microenvironment," Biomed Res Int. 2014:817613 (2014), 15 pages.

Stern, R., "Hyaluronidases in cancer biology," Semin Cancer Biol. 18(4):275-280 (2008).

News Release, Halozyme Therapeutics, Inc., "Halozyme's PEGPH20 program in metastatic pancreatic cancer receives fast track designation," Published on Sep. 3, 2014 [online] [retrieved on Sep. 15, 2014] Retrieved from:<URL:halozyme.com/Investors/News-Releases/News-Release-Details/2014/Halozymes-PEGPII20-Program-In-Metastatic-Pancreatic-Cancer-Receives-Fast-Track-Designation/default.aspx [2 pages].

News Release, "Halozyme resumes patient enrollment and dosing in PEGPH20 clinical program in pancreatic cancer," Published on Jul. 22, 2014 [online][retrieved on Aug. 18, 2014] Retrieved from the internet: <URL:halozyme.com/Investors/News-Releases/News-Release-Details/2014/Halozyme-Resumes-Patient-Enrollment-And-Dosing-In-PEGPH2O-Clinical-Program-In-Pancreatic-Cancer/default [3 pages].

Instructions, dated Aug. 20, 2014, for response to the Office Action, dated Apr. 9, 2014, in connection with Chinese Patent Application No. 200980122359.3, 13 pages.

Office Action, dated Jun. 29, 2014, in connection with Israeli Patent Application No. 208518, 5 pages.

Official Action, dated Jul. 1, 2014, in connection with Japanese Patent Application No. 2013-173089, 7 pages.

Instructions, dated May 25, 2014, for response to Office Action, dated Nov. 29, 2013, in connection with Korean Patent Application No. 10-2013-7026841, 23 pages.

Search Report and Written Opinion, dated Jun. 26, 2014, in connection with Singapore Patent Application No. 201300078-1, 15 pages.

U.S. Appl. No. 13/999,454, filed Feb. 26, 2014.

Letter/Written Disclosure of the Supplemental Information Disclosure Statement for the above-referenced application, dated Jun. 19, 2014, 2 pages.

Harooni et al., "Efficacy of hyaluronidase in reducing increases in intraocular pressure related to the use of viscoelastic substances," Arch Ophthalmol., 116(9):1218-1221 (1998).

Kerbel et al., "Induction and reversal of cell adhesion-dependent multicellular drug resistance in solid breast tumors," Hum Cell; 9(4):257-264 (1996).

Nekoroski et al., "A recombinant human hyaluronidase sustained release gel for the treatment of post-surgical edema," Int J Dermatol., from Oct. 29, 2013. doi: 10.1111/ijd.12304. [Epub ahead of print] 9 pages.

Frost, G., "Halozyme Therapeutics, Inc. Thinking outside the cell," from Oct. 2013, Presentation, 46 pages.

Hingorani et al., "A phase 1b study of gemcitabine plus PEGPH20 (pegylated recombinant human hyaluronidase) in patients with stage IV previously untreated pancreatic cancer," 2013 European Cancer Congress (ECC) Annual Meeting, Amsterdam, Netherlands—Sep. 27-Oct. 1, 2013, Abstract #2598, 2 pages.

Hingorani et al., "A phase 1 b multicenter international study of gemcitabine combined with PEGPH20 (PEGylated recombinant human hyaluronidase) in patients with stage IV previously untreated pancreatic cancer," 2013 European Cancer Congress (ECC) Annual Meeting, Amsterdam, Netherlands—Sep. 27-Oct. 1, 2013, Poster #2598 and individual panels, 5 pages.

Kultti et al., "Extracellular hyaluronan accumulation by hyaluronan synthase 3 promotes pancreatic cancer growth and modulates tumor microenvironment via epithelial-mesenchymal transition," AACR Annual Meeting 2014. San Diego, CA Abstract #4844, Available on-line Mar. 2014 [Retrieved form the Internet Mar. 18, 2014], 1 page.

Osgood et al., "Pegylated recombinant human hyaluronidase PH20 (PEGPH20) enhances cetuximab efficacy in BxPC-3/HAS3 human pancreatic cancer xenografts," AACR Annual Meeting 2014. San Diego, CA Abstract #3646, Available on-line Mar. 2014 [Retrieved form the internet Mar. 18, 2014], 1 page.

Torley, H., "Halozyme Therapeutics, Inc. The next chapter begins: creating value through growth," Presented at the 32nd Annual J.P. Morgan Healthcare Conference Jan. 2014, 26 pages.

News release, Halozyme Therapeutics, Inc., "Halozyme announces temporary halt of phase 2 trial enrollment and dosing for PEGPH20," Published on Apr. 4, 2014 [online][retrieved on Apr. 14, 2014] Retrieved from:<URL:halozyme.com/Investors/News-Releases/News-Release-Details/2014/Halozyme-Announces-Temporary-Halt-Of-Phase-2-Trial-Enrollment-And-Dosing-For-PEGPH20/default.aspx [2 pages].

News release, Halozyme Therapeutics, Inc., "Halozyme announces clinical hold of PEGPH20 pancreatic cancer trial following voluntary halt of trial by Halozyme," Published on Apr. 9, 2014 [online][retrieved on Apr. 14, 2014] Retrieved from:<URL:halozyme.com/Investors/News-Releases/News-Release-Details/2014/Halozyme-Announces-Clinical-Hold-of-PEGPH20-Pancreatic-Cancer-Trial-Following-Voluntary-Halt-of-Trial-by-Halozyme/default.aspx [2 pages].

News release, Halozyme Therapeutics, Inc., "Halozyme announces preclinical data presentations at the Association of Cancer Research Annual Meeting," Published on Apr. 8, 2014 [online][retrieved on Apr. 14, 2014] Retrieved from:<URL:halozyme.com/Investors/News-Releases/News-Release-Details/2014/Halozyme-Announces-Preclinical-Data-Presentations-At-The-Association-Of-Cancer-Research-Annual-Meeting/default.aspx [3 pages].

News Release, "Halozyme to Resume PEGPH20 Clinical Program in Pancreatic Cancer," Published on Jun. 4, 2014 [online][retrieved on Jun. 6, 2014] Retrieved from the internet: <URL: .halozyme.com/Investors/News-Releases/News-Release-Details/2014/Halozyme-To-Resume-PEGPH20-Clinical-Program-In-Pancreatic-Cancer/defaultaspx [2 pages].

Response, dated Jan. 22, 2014, to Examination Report, dated Mar. 1, 2013, in connection with corresponding Australian Patent Application No. 2009236635, 26 pages.

Notice of Acceptance, dated Jan. 31, 2014, in connection with corresponding Australian Patent Application No. 2009236635, 2 pages.

Examination Report, dated Mar. 21, 2014, in connection with corresponding Australian Patent Application No. 2013201899, 6 pages.

Response, dated May 15, 2014, to Examination Report, dated Nov. 22, 2013, in connection with corresponding New Zealand Patent Application No. 601248, 5 pages.

Notice of Acceptance, dated Jun. 4, 2014, in connection with corresponding New Zealand Patent Application No. 601248, 1 page.

Examiner's Report, dated Jan. 24, 2014, in connection with corresponding Canadian Patent Application No. 2,721,229, 5 pages.

Instructions, dated Nov. 15, 2013, for Response to Office Action, dated Jul. 8, 2013, in connection with in connection with corresponding Chinese Patent Application No. 200980122359.3, 18 pages.

Office Action, dated Apr. 9, 2014, in connection with corresponding Chinese Patent Application No. 200980122359.3 [English Translation], 8 pages.

Office Action, dated May 6, 2014, in connection with corresponding Chinese Patent Application No. 201310125280.4 [English Translation], 16 pages.

Response, dated May 13, 2014, to Search Report and Search Opinion, dated Oct. 10, 2013, in connection with corresponding European Patent Application No. 13178038.9, 14 pages.

U.S. Appl. No. 14/936,290, filed Nov. 9, 2015.

U.S. Appl. No. 14/628,120, filed Feb. 20, 2015, 2015/0165059, Jun. 18, 2015.

Letter/Written Disclosure of the Information Disclosure Statement for the above-referenced application, filed herewith on Mar. 7, 2016, 3 pages.

Letter, dated Feb. 10, 2016, reporting Decision to Grant, dated Feb. 9, 2016, in connection with Japanese Patent Application 2013-173089 [English letter reporting Decision to Grant and original document in Japanese], 4 pages.

(56) References Cited

OTHER PUBLICATIONS

Office Action, dated Jan. 29, 2016, in connection with Korean Patent Application No. 10-2015-7002593 [English Translation, original document in Korean and D1: WO 2006/091871], 303 pages.
Letter/Written Disclosure of the Information Disclosure Statement for the above-referenced application, filed herewith on May 17, 2016, 3 pages.
Examiner's Report, dated Apr. 4, 2016, in connection with Canadian Patent Application No. 2,721,229, 5 pages.
Office Action, dated Apr. 11, 2016, in connection with Chinese Patent Application No. 201310125280.4 [English Translation and original document in Chinese], 15 pages.
Letter/Written Disclosure of the Supplemental Information Disclosure Statement for the above-referenced application, filed herewith Feb. 17, 2015, 2 pages.
Office Action, dated Dec. 23, 2014, and dated Jan. 15, 2015, in connection with Chinese Patent Application No. 200980122359.3 [Original document in Chinese, English Translation, and D1: WO 2006/091871], 306 pages.
Letter/Written Disclosure of the Supplemental Information Disclosure Statement for the above-referenced application, dated Dec. 16, 2014, 2 pages.
Office Action, dated Oct. 30, 2014 (dated Nov. 16, 2014, in connection with Korean Patent Application No. 10-2013-7026841[English Translation and original document in Korean], 9 pages.
Letter/Written Disclosure of the Supplemental Information Disclosure Statement for the above-referenced application, filed herewith Jan. 21, 2016, 2 pages.
Huang et al., "Characterization of hyaluronan, hyaluronidase PH20, and HA synthase HAS2 in inflammation and cancer," Inflammation & Cell Signaling 1:e306 6 pages (2014).
Jadin et al., "Characterization of a novel recombinant hyaluronan binding protein for tissue hyaluronan detection," J Histochem Cytochem 62(9):672-683 (2014).
Singha et al., "Tumor-associated Hyaluronan limits efficacy of monoclonal antibody therapy," Mol Cancer Ther DOI: 10.1158/1535-7163.MCT-14-0580 [Epub ahead of print], 523-532 (2014).
"PEGPH20: The Science & The Strategy," presented at J. P. Morgan Healthcare Conference on Jan. 7, 2015. Presentation, 81 pages.
Gelb et al., "Abstract 576: Development and analytical validation of a novel assay for tissue detection of hyaluronan in the tumor microenvironment to select patients for molecularly targeted pancreatic cancer therapies," presented at AACR Annual Meeting. Apr. 20, 2015. Philadelphia, PA, 2 pages.
Whatcott et al., "Abstract 191: Desmoplasia in primary tumors and metastatic lesions of pancreatic cancer," Cancer Res 74: 191 (2014) [Proceedings: AACR Annual Meeting 2014; Apr. 5-9, 2014; San Diego, CA].
News release, Halozyme Therapeutics, Inc, "Halozyme announces podium presentation on PEGPH20 at the New York Academy of Sciences." Published Oct. 9, 2014 [online], Retrieved from:<URL:halozyme.com/Investors/News-Releases/News-Release-Details/2014/Halozyme-Announces-Podium-Presentation-On-PEGPH20-At-The-New-York-Academy-Of-Sciences/default.aspx [retrieved on Oct. 10, 2014], 3 pages.
News Release, Halozyme Therapeutics, Inc., "Halozyme receives orphan drug designation for PEGylated recombinant human hyaluronidase PH20 for pancreatic cancer," Published Oct. 3, 2014 [online], Retrieved from:<URL:halozyme.com/Investors/News-Releases/News-Release-Details/2014/Halozyme-Receives-Orphan-Drug-Designation-For-PEGylated-Recombinant-Human-Hyaluronidase-PH20-For-Pancreatic-Cancer/default.aspx [retrieved on Oct. 7, 2014], 2 pages.
News Release, "Halozyme Announces Presentations of Preclinical Data at the San Antonio Breast Cancer Symposium Annual Meeting," Published Dec. 12, 2014 [online], Retrieved from the internet: <URL:halozyme.com/Investors/News-Releases/News-Release-Details/2014/Halozyme-Announces-Presentations-Of-Preclinical-Data-At-The-San-Antonio-Breast-Cancer-Symposium-Annual-Meeting/default.aspx [retrieved on Dec. 15, 2014], 3 pages.
News Release, "Halozyme receives European orphan drug designation for PEGylated recombinant human hyaluronidase PH20 for pancreatic cancer," Published Dec. 19, 2014 [online], Retrieved from: <URL:halozyme.com/Investors/News-Releases/News-Release-Details/2014/Halozyme-Receives-European-Orphan-Drug Designation-For-PEGylated-Recombinant-Human-Hyaluronidase PH20-For-Pancreatic-Cancer/default.aspx [retrieved on Dec. 29, 2014], 3 pages.
News Release, Halozyme Therapeutics, Inc., "Halozyme Therapeutics provides an update on anticipated milestones for 2015 at the 33rd Annual J. P. Morgan Healthcare Conference," Published Jan. 12, 2015 [online], Retrieved from: <URL:halozyme.com/Investors/News-Releases/News-Release-Details/2015/Halozyme-Therapeutics-Provides-An-Update-On-Anticipated-Milestones-For-2015-At-The-33rd-Annual-J-P-Morgan-Healthcare-Conference/default.aspx [retrieved on Jan. 14, 2015], 3 pages.
News Release, Halozyme Therapeutics, Inc., "Halozyme announces preclinical study results of PEGPH20 published in Molecular Cancer Therapeutics," Published Feb. 17, 2015 [online], Retrieved from: <URL: halozyme.com/Investors/News-Releases/News-Release-Details/2015/Halozyme-Announces-Preclinical-Study-Results-Of-PEGPH20-Published-In-Molecular-Cancer-Therapeutics/default.aspx [retrieved on Feb. 20, 2015], 3 pages.
News Release, Halozyme Therapeutics, Inc., "Halozyme Therapeutics reports selection of first product candidate under Janssen Collaboration," Published Mar. 10, 2015 [online], Retrieved from: <URL:halozyme.com/Investers/News-Releases/News-Release-Details/2015/Halozyme-Therapeuties-Reports-Selection-Of-First-Product-Candidate-Under-Janssen-Collaboration/default.aspx [retrieved on Mar. 10, 2015], 3 pages.
News Release, Halozyme Therapeutics, Inc., "Halozyme provides update following Type B FDA Meeting," Published Apr. 8, 2015 [online], Retrieved from: <URL:halozyme.com/Investors/News-Releases/News-Release-Details/2015/Halozyme-Provides-Update-Following-Type-B-FDA-Meeting/default.aspx [retrieved on Apr. 8, 2015], 3 pages.
News Release, Halozyme Therapeutics, Inc., "Halozyme presents new preclinical data at the American Association for Cancer Research Annual Meeting, announces clinical data presentation at ASCO," Published Apr. 20, 2015 [online], Retrieved from: <URL:halozyme.com/Investors/News-Releases/News-Release-Details/2015/Halozyme-Presents-New-Preclinical-Data-At-The-American-Association-for-Cancer-Rescarch-Annual-Meeting-Announces-Clinical-Data-Presentation-At-ASCO/default.aspx [retrieved on Apr. 20, 2015], 4 pages.
News Release, Halozyme Therapeutics, Inc., "Halozyme, Ventana Enter into Global Agreement to Collaboratively Develop Companion Diagnostic for Cancer Treatment," Published May 27, 2015 [online]. Retrieved from: <URL:halozyme.com/Investors/News-Releases/News-Release-Details/2015/Halozyme-Ventana-Enter-Into-Global-Agreernent-To-Collaboratively-Develop-Companion-Diagnostic-For-Cancer-Treatment/default.aspx [retrieved on May 27, 2015], 4 pages.
News Release, Halozyme Therapeutics, Inc., "Halozyme Phase 2 clinical study of investigational drug PEGPH20 shows doubling of progression-free survival and improvement trend in overall survival in high HA Metastatic Pancreatic Cancer Patients," Published May 31, 2015 [online], Retrieved from: <URL:prnewswire.com/news-releases/halozyme-phase-2-clinical-study-of-investigational-drug-pegph20-shows-doubling-of-progression-free-survival-and-improvement-trend-in-overall-survival-in-high-ha-metastatic-pancreatic-cancer-patients-300091301.html [retrieved on Jun. 2, 2015], 4 pages.
News Release, Halozyme Therapeutics, Inc., "UCSF to Study Halozyme PEGPH20 in Pancreatic Cancer Patients Who Are Candidates for Potentially Curative Surgery," Published Aug. 6, 2015 [online], Retrieved from: <URL:halozyme.com/Investors/News-Releases/News-Release-Details/2015/UCSF-To-Study-Halozyme-PEGPH20-In-Pancreatic-Cancer-Patients-Who-Are-Candidates-For-Potentially-Curative-Surgery/default.aspx [retrieved on Aug. 11, 2015], 3 pages.

(56) References Cited

OTHER PUBLICATIONS

News Release, Halozyme Therapeutics, Inc., "First Patient Dosed in Clinical Trial of Halozyme Investigational Drug PEGPH20 in Combination With Merck Immuno-oncology Drug KEYTRUDA," Published Nov. 5, 2015 [online], Retrieved from: <URL: halozyme.com/Investors/News-Releases/News-Release-Details/2015/First-Patient-Dosed-in-Clinical-Trial-of-Halozyme-Investigational-Drug-PEGPH20-in-Combination-With-Merck-Immuno-oncology-Drug-KEYTRUDA/default.aspx [retrieved on Nov. 5, 2015], 3 pages.
Response, filed Jun. 2, 2015, to Examination Report, dated Mar. 21, 2014, in connection with Australian Patent Application No. 2013201899, 30 pages.
Notice of Acceptance, dated Aug. 13, 2015, in connection with Australian Patent Application No. 2013201899, 2 pages.
Response, filed Jul. 23, 2015, to Examiner's Report, dated Jan. 24, 2014, in connection with Canadian Patent Application No. 2,721,229, 41 pages.
Response, filed May 6, 2015, to Office Action, dated Dec. 23, 2014, in connection with Chinese Patent Application No. 200980122359.3 [English instructions and documents as filed in Chinese], 27 pages.
Office Action, dated Sep. 9, 2015, in connection with Chinese Patent Application No. 200980122359.3 [Original document in Chinese and English Translation], 13 pages.
Instructions, dated Nov. 11, 2014, for response to the Office Action, dated May 6, 2014, in connection with Chinese Patent Application No. 201310125280.4, 28 pages.
Office Action, dated Feb. 13, 2015, in connection with Chinese Patent Application No. 201310125280.4 [English Translation and original document in Chinese], 11 pages.
Response, filed Jun. 26, 2015, to Office Action, dated Feb. 13, 2015, in connection with Chinese Patent Application No. 201310125280.4 [English Instructions and document as filed in Chinese], 17 pages.
Office Action, dated Sep. 8, 2015, in connection with Chinese Patent Application No. 201310125280.4 [English Translation and original document in Chinese], 11 pages.
Examination Report, dated Oct. 27, 2015, in connection with European Patent Application No. 13178038.9, 4 pages.
English translation of Response, filed Mar. 22, 2015, to Office Action, dated Jun. 29, 2014, in connection with Israeli Patent Application No. 208518, 8 pages.
English translation of Office Action, dated Oct. 11, 2015, in connection with Israeli Patent Application No. 208518, 2 pages.
Response, filed Jan. 5, 2015, to Official Action, dated Jul. 1, 2014, in connection with Japanese Patent Application No. 2013-173089 [English language instructions and Response as filed in Japanese], 44 pages.
Final Rejection, dated Jun. 9, 2015, in connection with Japanese Patent Application 2013-173089 [English language translation and original document in Japanese], 10 pages.
Appeal, filed Nov. 25, 2015, to Final Rejection, dated Jun. 9, 2015, in connection with Japanese Patent Application 2013-173089 [English language instructions and document as filed in Japanese], 18 pages.
Appeal, filed Jan. 29, 2015, in connection with Korean Patent Application No. 10-2013-7026841 [English Instructions and document as filed in Korean], 6 pages.
Office Action, dated May 1, 2015, in connection with Korean Patent Application No. 10-2015-7002593 [English Translation and original document in Korean], 14 pages.
Response, filed Oct. 1, 2015, to Office Action, dated May 1, 2015, in connection with Korean Patent Application No. 10-2015-7002593 [English language instructions and document as filed, in Korean], 86 pages.
Response, filed Nov. 26, 2014, to Written Opinion, dated Jun. 26, 2014, in connection with Singapore Patent Application No. 201300078-1, 25 pages.
Examination Report, dated Sep. 1, 2015, in connection with Singapore Patent Application No. 201300078-1, 6 pages.
Request for Reexamination, filed Dec. 17, 2015, filed in response to Office Action, dated Sep. 9, 2015, in connection with Chinese Patent Application No. 200980122359.3 [English instructions and document as filed in Chinese], 30 pages.
Gelb, A.B., "Developing a companion diagnostic for detection of hyaluronan, a key component of the tumor microenvironment," presented at World CDx Meeting, Sep. 10, 2015. Boston, MA. Presentation, 25 pages.
Letter/Written Disclosure of the Supplemental Information Disclosure Statement for the above-referenced application, filed herewith on Mar. 10, 2017, 2 pages.
Notification of Reexamination, dated Jan. 25, 2017, in connection with Chinese Patent Application No. 201310125280.4 [English Translation and original document in Chinese], 14 pages.
Letter/Written Disclosure of the Supplemental Information Disclosure Statement for the above-referenced application, filed herewith on Dec. 14, 2016, 2 pages.
Hylenex recombinant (hyaluronidase recombinant human) injection, solution. Published on Feb. 29, 2008 in Dosage and Administration: Subcutaneous Urography. Retrieved from <URL: dailymed.nlm.nih.gov/dailymed/archives/fdaDrugInfo.cfm?archiveid=7523 [Retrieved on Jul. 27, 2016], 6 pages.
Belani, B., "PEGPH20: Update on investigation in lung cancer," Presented at Targeted Therapies of Lung Cancer Meeting Feb. 17-20, 2016, 7 pages.
Gelb et al., "Development and analytical validation of a novel assay for tissue detection of hyaluronan in the tumor microenvironment to select patients for molecularly targeted pancreatic cancer therapies," presented at AACR Annual Meeting, Apr. 9, 2015. Philadelphia, PA. Poster #576 and panels, 10 pages.
Torley, H., "Platforms for Growth: Building a Premier Oncology Biotech," Presented at the 34nd Annual J.P. Morgan Healthcare Conference on Jan. 12, 2016, 26 pages.
News Release, Halozyme Therapeutics, Inc., "Halozyme Provides Key Program Updates, 2016 Financial Guidance at 34th Annual JP Morgan Healthcare Conference," Published Jan. 11, 2016, [online],Retrieved from: <URL: prnewswire.com/news-releases/halozyme-provides-key-program-updates-2016-financial-guidance-at-34th-annual-jp-morgan-healthcare-conference-300202007.html [retrieved on Jan. 14, 2016], 5 pages.
News Release, Halozyme Therapeutics, Inc., "Halozyme Announces First Clinical Dosing of Adalimumab (Humira) Using ENHANZE™ Technology," Published Jan. 21, 2016 [online], Retrieved from: <URL: halozyme.com/investors/news-releases/news-release-details/2016/Halozyme-Announces-First-Clinical-Dosing-Of-Adalimumab-Humira-Using-ENHANZE-Technology/default.aspx [retrieved on Jan. 21, 2016], 4 pages.
News Release, Halozyme Therapeutics, Inc., "Halozyme Doses First Patient in Phase 3 Clinical Trial of PEGPH20 in Combination With ABRAXANE® and Gemcitabine," Published Mar. 16, 2016 [online], Retrieved from: <URL: halozyme.com/investors/news-releases/news-release-details/2016/Halozyme-Doses-First-Patient-In-Phase-3-Clinical-Trial-Of-PEGPH20-In-Combination-With-ABRAXANE-And-Gemcitabine/default.aspx [retrieved on Mar. 16, 2016], 5 pages.
News Release, Halozyme Therapeutics, Inc., "Halozyme Presents Stage One Efficacy and Safety Analysis of Phase 2 Clinical Study in Metastatic Pancreatic Cancer Patients Treated with PEGPH20," Published Jun. 4, 2016 [online], Retrieved from: <URL:halozyme.com/investors/news-releases/news-release-details/2016/Halozyme-Presents-Stage-One-Efficacy-And-Safety-Analysis-Of-Phase-2-Clinical-Study-In-Metastatic-Pancreatic-Cancer-Patients-Treated-With-PEGPH20/default.aspx [retrieved on Jun. 7, 2016], 6 pages.
Response, filed Sep. 2, 2016, to Examiner's Report, dated Apr. 4, 2016, in connection with Canadian Patent Application No. 2,721,229, 15 pages.
Response, filed Jan. 18, 2016, to Office Action, dated Sep. 8, 2015, in connection with Chinese Patent Application No. 201310125280.4 [English Instructions and document as filed in Chinese], 21 pages.
Response, filed Jul. 26, 2016, to Office Action, dated Apr. 11, 2016, in connection with Chinese Patent Application No. 201310125280.4 [English instructions and document as filed in Chinese], 25 pages.
Response, filed Mar. 1, 2016, to Examination Report, dated Oct. 27, 2015, in connection with European Patent Application No. 13178038.9, 20 pages.

(56) References Cited

OTHER PUBLICATIONS

Summons to Attend Oral Proceedings, dated Sep. 15, 2016, in connection with European Patent Application No. 13178038.9 [Cited document D1=WO 2006/09187], 5 pages.
English translation of Response, filed Feb. 11, 2016, to Office Action, dated Oct. 11, 2015, in connection with Israeli Patent Application No. 208518, 3 pages.
English translation of Office Action, dated Jan. 7, 2016, in connection with Indian Patent Application No. 7948/DELNP/2010, 4 pages.
Office Action, dated Aug. 16, 2016, in connection with Japanese Patent Application No. 2015-201197 [English translation, English Summary and original document in Japanese], 10 pages.
Notice of Appeal and Amendment, filed May 2, 2016, to Office Action, dated Jan. 29, 2016, in connection with Korean Patent Application No. 10-2015-7002593 [English Instructions and document as filed in Korean], 41 pages.
Decision to Grant, dated Jun. 21, 2016, in connection with Korean Patent Application No. 10-2015-7002593 [English Translation and original document in Korean], 3 pages.
Office Action, dated Jul. 19, 2016, in connection with Korean Patent Application No. 10-2016-7011691 [English Translation and original document in Korean], 13 pages.
Notification of Reexamination, dated Nov. 7, 2016, in connection with Chinese Patent Application No. 200980122359.3 [Original document in Chinese and English Translation], 20 pages.
Letter/Written Disclosure of the Supplemental Information Disclosure Statement for the above-referenced application, filed herewith on Jan. 11, 2018, 2 pages.
Hingorani et al., "HALO 202: Randomized Phase II Study of PEGPH20 Plus Nab-Paclitaxel/Gemcitabine Versus Nab-Paclitaxel/ Gemcitabine in Patients with Untreated, Metastatic Pancreatic Ductal Adenocarcinoma," J Clin Oncol doi: 10.1200/JCO.2017.74. 9564. [Epub ahead of print] [Published online on Dec. 12, 2017], 12 pages.
Hingorani et al., "Randomized phase II study of PEGPH20 plus nab-paclitaxel/ gemcitabine (PAG) vs AG in patients (Pts) with untreated, metastatic pancreatic ductal adenocarcinoma (mPDA)," 2017 ASCO Annual Meeting, Chicago, IL, Abstract #4008, 2 pages.
Hingorani et al., "Randomized phase II study of PEGPH20 plus nab-paclitaxel/ gemcitabine (PAG) vs AG in patients (Pts) with untreated, metastatic pancreatic ductal adenocarcinoma (mPDA)," Presented at 2017 ASCO Annual Meeting, Chicago, IL [Presentation, 16 pages].
Fda News Release, "FDA approves Abraxane for late-stage pancreatic cancer," Published on Sep. 6, 2013 [online] Retrieved from <URL:fda.gov/NewsEvents/Newsroom/PressAnnouncements/ ucm367442.htm [Retrieved on Feb. 22, 2017], 2 pages.
New Release, "Halozyme Provides Program Updates, 2017 Financial Guidance At 35th Annual JP Morgan Healthcare Conference," Published Jan. 9, 2017 [online] Retrieved from:<URL:halozyme. com/investors/news-releases/news-release-details/2017/Halozyme-Provides-Program-Updates-2017-Financial-Guidance-At-35th-Annual-JP-Morgan-Healthcare-Conference/default.aspx#sthash.toLNTSgp. dpuf [retrieved on Jan. 17, 2017], 4 pages.
New Release, "FDA Approves Genentech's RITUXAN HYCELA, a Subcutaneous Rituximab Coformulated with Halozyme ENHAZE Technology," Published Jun. 22, 2017 [online] Retrieved from:<URL:halozyme.com/investors/news-releases/news-release-details/2017/FDA-Approves-Genentechs-RITUXAN-HYCELA-A-Subcutaneous-Rituximab-Coformulated-With-Halozyme-Enhanze-Technology/default.aspx [retrieved on Jun. 27, 2017], 3 pages.
News Release, "Bristol-Myers Squibb and Halozyme Enter Global Collaboration and License Agreement for ENHANZE Technology," Published Sep. 14, 2017 [online] Retrieved from:<URL: halozyme. com/investors/news-releases/news-release-details/2017/Bristol-Myers-Squibb-and-Halozyme-Enter-Global-Collaboration-and-License-Agreement-for-ENHANZE-Technology/default.aspx [retrieved on Sep. 14, 2017], 7 pages.

Examiner's Report, dated May 31, 2017, in connection with Canadian Patent Application No. 2,721,229, 4 pages.
Response, filed May 9, 2017, and Supplemental Response, filed May 18, 2017, to Office Action, dated Jan. 25, 2017, in connection with Chinese Patent Application No. 201310125280.4 [English instructions and document as filed in Chinese with English translation of claims as filed], 30 pages.
Decision of Reexamination, dated Sep. 19, 2017, in connection with Chinese Patent Application No. 201310125280.4 [English Translation and original document in Chinese], 19 pages.
Request to Withdraw Application, filed Feb. 21, 2017, in connection with European Patent Application No. 13178038.9, 1 page.
Extended Search Report, dated May 11, 2017, issued in connection with European Patent Application No. 17155962.8, 13 pages.
Letter, dated Jan. 2, 2017, reporting Notification Prior to Acceptance, dated Dec. 25, 2016, in connection with Israel Patent Application No. 208518, 4 pages.
Response, filed Dec. 27, 2016, to Office Action, dated Jan. 7, 2016, in connection with Indian Patent Application No. 7948/DELNP/ 2010, 44 pages.
Response, dated Jan. 5, 2017, to Office Action, dated Aug. 16, 2016, in connection with Japanese Patent Application No. 2015-201197 [English instructions and document as filed in Japanese], 37 pages.
Office Action, dated Apr. 4, 2017, in connection with Japanese Patent Application No. 2015-201197 [English translation and original document in Japanese], 6 pages.
Response, filed Aug. 3, 2017, to Office Action, dated Apr. 4, 2017, in connection with Japanese Patent Application No. 2015-201197 [English instructions and document as filed in Japanese], 18 pages.
Decision to Grant, dated Nov. 28, 2017, in connection with Japanese Patent Application No. 2015-201197 [English reporting letter and original document in Japanese], 4 pages.
U.S. Appl. No. 15/591,011, filed May 9, 2017, 2017/0246264, Aug. 31, 2017.
U.S. Appl. No. 15/904,247, filed Feb. 23, 2018.
U.S. Appl. No. 15/130,860, filed Apr. 15, 2016, 2016/0220690, Aug. 4, 2016.
U.S. Appl. No. 15/625,177, filed Jun. 16, 2017, 2017/0290796, Oct. 12, 2017.
Letter/Written Disclosure of the Supplemental Information Disclosure Statement for the above-referenced application, filed herewith on May 21, 2018, 2 pages.
Response, filed Jan. 19, 2018, to Extended Search Report, dated May 11, 2017, issued in connection with European Patent Application No. 17155962.8, 43 pages.
Hearing Notice, dated Mar. 16, 2018, issued in connection with Indian Patent Application No. 7948/DELNP/2010, 2 pages.
Letter/Written Disclosure of the Supplemental Information Disclosure Statement for the above-referenced application, filed herewith on Dec. 13, 2018, 2 pages.
Li et al., "Parallel Accumulation of Tumor Hyaluronan, Collagen, and Other Drivers of Tumor Progression," J Clin Canc Res 24(19): 4798-4807 (2018).
Von Hoff et al., "Increased Survival in Pancreatic Cancer with nab-Paclitaxel Plus Gemcitabine," New Eng J Med 369(18): 1691-1703 (2013).
Hendifar et al., "Tumor Hyaluronan (HA) Is a Novel Biomarker: Results of the Randomized Phase 2 HALO-202 Study of PEGPH20 (pegvorhyaluronidase alfa) Plus nab-Paclitaxel/Gemcitabine (PAG) vs AG in Previously Untreated, Metastatic Pancreatic Ductal Adenocarcinoma (mPDA)," Presented at the 2017 ASCO Annual Meeting, Chicago, IL, Poster 743P [Poster and Individual Panels], 6 pages.
Hingorani et al., "HALO-202: Randomized Phase 2 Study of PEGPH20 (pegvorhyaluronidase alfa) Plus nab-Paclitaxel/ Gemcitabine (PAG) vs. AG in Patients (Pts) with Untreated, Metastatic Pancreatic Ductal Adenocarcinoma (mPDA)," 2017 ASCO Annual Meeting, Chicago, IL, Poster 763P [Poster and Individual Panels], 8 pages.
Oh et al., "Phase 3, randomized, double-blind, placebo-controlled study of PEGylated recombinant human hyaluronidase PH20 (PEGPH20)+nab-paclitaxel/gemcitabine in patients with previously

(56) References Cited

OTHER PUBLICATIONS untreated, hyaluronan-high, stage Iv pancreatic ductal adenocarcinoma (PDA)," Presented at ESMO Asia Congress Singapore Nov. 17-19, 2017. Abstract 260TiP, 2 pages.
Rainey et al., "PEGylated hyaluronidase increases tumor uptake of Zr-DFO-HuMab-5B1 (MVT-2163) in a CA19-9 positive hyaluronan accumulating pancreatic cancer model," AACR Annual Meeting Apr. 14-18, 2018. Chicago, IL. Poster #3036 [poster and panels], 8 pages.
Shum et al., "Early results from an open-label phase 1b/II study of eribulin mesylate (EM) + pegvorhyaluronidase alfa (PEGHP20) combination for the treatment of patients with HER2-negative, high-hyaluronan (HA) metastatic breast cancer (MBC)," presented at ESMO Conference Oct. 19-23 [available online on Oct. 9, 2018; retrieved Oct. 23, 2018]. Abstract 311P, 1 page.
Stelzer, L., "Platforms for Growth: Building a Premier Oncology Biotech," Presented at the Canaccord Genuity 38th Annual Growth Conference on Aug. 9, 2018, 24 pages.
Van Cutsem et al, "Global Phase 3, Randomized, Double-Blind, Placebo-Controlled Study Evaluating PEGylated Recombinant Human Hyaluronidase PH20 (PEGPH20) Plus nab-Paclitaxel and Gemcitabine in Patients with Previously Untreated, Hyaluronan (HA)-High, Stage IV Pancreatic Ductal Adenocarcinoma," Presented at 2017 ASCO Annual Meeting, Chicago, IL, Poster 774TiP [Poster and Individual Panels], 5 pages.
Yu et al., "A pilot study of gemcitabine, nab-paclitaxel, PEGPH20 (PAG) and rivaroxaban for advanced pancreatic adenocarcinoma: interim safety and efficacy analysis," presented at ESMO Conference Oct. 19-23 [available online on Oct. 9, 2018; retrieved Oct. 23, 2018]. Abstract 730P, 1 page.
Yu et al., "Pilot Study of Gemcitabine, Nab-paclitaxel, PEGPH20 and Rivaroxaban for Advanced Pancreatic Adenocarcinoma, an Interim Analysis," presented at the 2018 Gastrointestinal Cancers Symposium, Jan. 18-20, San Francisco, CA. Poster 405, 1 page.
News Article, "Alteogen Inc. to Develop Herceptin Biosimilar for Subcutaneous Injection," Published on Aug. 23, 2018 [online] Retrieved from: <URL:thebell.co.kr/free/Content/ArticleView.asp?key=201808220100037100002360 [Original documents retrieved fom the internet and English translation], 4 pages.
News Article, "[Promising biocompany] Alteogen Inc. tries to differentiate itself with specialized bio technology and strategy," Published on Sep. 17, 2018 [online] Retrieved from: <URL: edaily.co.kr/news/read?newsId=01105366619341104&mediaCodeNo=257&OuthkChk=Y [Original documents retrieved from the internet and English translation], 4 pages.
News Release, Halozyme Therapeutics, Inc., "Halozyme Publication in the Journal Clinical Cancer Research Highlights New Nonclinical Data Supporting Multiple Effects of PEGPH20 on the Tumor Microenvironment," Published Oct. 4, 2018 [online] Retrieved from:<URL: halozyme.com/investors/news-releases/news-release-details/2018/Halozyme-Publication-In-The-Journal-Clinical-Cancer-Research-Highlights-New-Nonclinical-Data-Supporting-Multiple-Effects-Of-PEGPH20-On-The-Tumor-Microenvironment/default.aspx [retrieved on Oct. 5, 2018], 4 pages.
News Release, Halozyme Therapeutics, Inc., "Halozyme Provides Summary Results of Data for PEGPH20 Combination Treatments Presented at ESMO 2018 Congress," Published Oct. 22, 2018 [online] Retrieved from:<URL: halozyme.com/investors/news-releases/news-release-details/2018/Halozyme-Provides-Summary-Results-Of-Data-For-PEGPH20-Combination-Treatments-Presented-At-ESMO-2018-Congress/default.aspx [retrieved on Oct. 23, 2018], 4 pages.
News Release, Halozyme Therapeutics, Inc., "Halozyme Announces First Clinical Dosing in Bristol-Myers Squibb's Phase 1 Trial of BMS-986179 With Enhanze® Technology," Published Oct. 25, 2018 [online] Retrieved from:<URL: halozyme.com/investors/news-releases/news-release-details/2018/Halozyme-Announces-First-Clinical-Dosing-In-Bristol-Myers-Squibbs-Phase-1-Trial-Of-BMS-986179-With-Enhanze-Technology/default.aspx [retrieved on Oct. 26, 2018], 5 pages.
News Release, Halozyme Therapeutics, Inc., "Halozyme Announces Change In Primary Endpoint for HALO-301 to Overall Survival," Published Nov. 26, 2018 [online] Retrieved from:<URL:https://s21.q4cdn.com/250105458/files/doc_downloads/2018/11/PR-112618-Final.pdf [retrieved on Nov. 27, 2018], 3 pages.
News Article, "Alteogen, Inc. challenges to the ethical drug market by utilizing 'Human Hyaluronidase'," Published on Oct. 29, 2018 [online] Retrieved from: <URL:fnnews.com/news/201810290941498520 [Original documents retrieved from the internet and English translation], 6 pages.
Response, filed Jun. 7, 2018, to Examiner's Report, dated May 31, 2017, in connection with Canadian Patent Application No. 2,721,229, 51 pages.
Examination Report, dated Nov. 2, 2018, in connection with European Patent Application No. 17155962.8, 5 pages.
Letter/Written Disclosure of the Supplemental Information Disclosure Statement for the above-referenced application, filed herewith on May 2, 2019, 3 pages.
Examiner's Report, dated Apr. 1, 2019, in connection with Canadian Patent Application No. 2,721,229, 6 pages.
Boregowda et al., "Expression of hyaluronan in human tumor progression," J Carcinogenesis 5(2) (2006), 9 pages.
Mummert et al., "Functional roles of hyaluronan in B16-F10 melanoma growth and experimental metastasis in mice," Mol Canc Ther 2: 295-300 (2003).

* cited by examiner

MODIFIED HYALURONIDASES AND USES IN TREATING HYALURONAN-ASSOCIATED DISEASES AND CONDITIONS

RELATED APPLICATIONS

This application is a continuation of U.S. application Ser. No. 12/386,222, entitled "MODIFIED HYALURONIDASES AND USES IN TREATING HYALURONAN-ASSOCIATED DISEASES AND CONDITIONS," filed on Apr. 14, 2009, now abandoned which claims priority under 35 U.S.C. § 119(e) to U.S. Provisional Application Ser. No. 61/124,278 to Gregory Frost, entitled "COMBINATION THERAPY USING A MODIFIED SOLUBLE HYALURONIDASE AND THERAPEUTIC AGENTS AND TREATMENTS," filed on Apr. 14, 2008; to U.S. Provisional Application Ser. No. 61/130,357 to Gregory Frost, entitled "COMBINATION THERAPY USING A SOLUBLE HYALURONIDASE AND CHEMOTHERAPEUTIC AGENTS," filed on May 29, 2008; and to U.S. Provisional Application Ser. No. 61/195,624 to Gregory Frost, entitled "MODIFIED HYALURONIDASES AND USES IN TREATING HYALURONAN-ASSOCIATED DISEASES AND CONDITIONS," filed on Oct. 8, 2008.

This application is related to International Application No. PCT/US09/002,352, filed the same day herewith, entitled "MODIFIED HYALURONIDASES AND USES IN TREATING HYALURONAN-ASSOCIATED DISEASES AND CONDITIONS," which claims priority to U.S. Provisional Application Ser. Nos. 61/124,278, 61/130,357, and 61/195,624. The subject matter of the above-noted related application is incorporated by reference in its entirety.

The subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Feb. 22, 2012, is identical, 799 kilobytes in size, and titled 3066BSEQ.001.txt.

FIELD OF THE INVENTION

Provided are combinations, compositions and kits containing a hyaluronan degrading enzyme, in particular, a soluble hyaluronidase, for treatment of hyaluronan-associated conditions, diseases and disorders. In one example, the products include an additional agent or treatment. Such products can be used in methods for administering the products to treat the hyaluronan-associated diseases and conditions, for example, hyaluronan-associated cancers, for example, hyaluronan-rich tumors. The methods include administration of the hyaluronan degrading enzyme composition, such as a hyaluronidase composition, alone or in combination with other treatments. Also provided are methods and compositions for providing sustained treatment effects in hyaluronan-associated diseases and conditions.

BACKGROUND

Hyaluronan (hyaluronic acid; HA) is a glycosaminoglycan that exists predominantly in connective tissues, skin, cartilage, and in synovial fluid in mammals. Hyaluronan also is the main constituent of the vitreous of the eye. In connective tissue, the water of hydration associated with hyaluronan creates hydrated matrices between tissues. HA is found in the extracellular matrix of many cells, especially in soft connective tissues. HA has a role in various physiological processes, such as in water and plasma protein homeostasis, in the intracellular matrix (Laurent T C et al (1992) FASEB J 6: 2397-2404). Certain diseases are associated with expression and/or production of hyaluronan.

Hyaluronan degrading enzymes, including hyaluronidases, are enzymes that degrade hyaluronan. Various hyaluronan degrading enzymes have been used therapeutically, typically as dispersing and spreading agents in combination with other therapeutic agents. Improved compositions and methods for administration of hyaluronan degrading enzymes for treatment, particularly of hyaluronan-associated diseases and conditions, are needed.

SUMMARY

Provided are methods for treating hyaluronan-associated diseases or conditions. The methods include a step of administering a hyaluronan degrading enzyme, such as a hyaluronidase, particularly a soluble hyaluronidase, such as any of the animal or bacterial hyaluronidases. The hyaluronan degrading enzyme is modified with a polymer, such as a pegylation moiety. Exemplary of such are the hyaluronan degrading enzymes are soluble human hyaluronidases. Such soluble hyaluronidases and preparations thereof are described, for example, in U.S. patent application Ser. No. 10/795,095, published as US 20040268425, U.S. patent application Ser. No. 11/065,716, published as US 20050260186, U.S. patent application Ser. No. 11/238,171, published as US 20060104968. Such soluble hyaluronidases are modified with a polymer, such as a pegylation moiety. The hyaluronan degrading enzyme, such as a hyaluronidase, is modified with a polymer to alter a property, such as, but not limited to, half-life and pharmacokinetics. The modification includes linking directly or indirectly via a linker, such as covalently or by other stable linkage, a polymer, such as dextran, a pegylation or sialation moiety, or other such polymers, such as natural or sugar polymers. In the exemplary embodiments herein, the hyaluronan degrading enzyme is pegylated.

Provided herein are methods for treating a disease or condition in which a hyaluronidase substrate accumulates, and methods for treating a hyaluronan-associated disease or condition. Such methods include administering a soluble hyaluronidase that is modified by conjugation to a polymer. Also provided herein are compositions containing a soluble hyaluronidase in an amount sufficient for maintaining a plasma level of the hyaluronidase enzyme in plasma at a level of at least 3 U/mL for at least a week, and combinations containing such compositions. The soluble hyaluronidase in the compositions and combinations provided herein is conjugated to a polymer.

Provided herein are methods for treating a disease or condition in which a hyaluronidase substrate accumulates. The methods involve administering a soluble hyaluronidase enzyme to a subject more than once a week for a predetermined number of weeks in an amount sufficient to maintain a pharmacologically active level of the hyaluronidase in the plasma of at least about or 3 U/mL to prevent resynthesis of the substrate to levels prior to treatment. The hyaluronidase enzyme used in the methods is modified by conjugation to a polymer, and the predetermined number of weeks is more than one week. In some examples, the predetermined number of weeks is at least two weeks, such as two weeks, three weeks, or four weeks. Exemplary hyaluronidase substrates that accumulate in the condition or disease being treated include hyaluronan. In one example, the hyaluronan expression in a sample from the subject is measured prior to treatment.

In some examples of the methods for treating a disease or condition in which a hyaluronidase substrate accumulates, after the predetermined number of weeks, administration is discontinued for a first predetermined period of time, such as at least one week, and then resumed for at least one week. For example, administration can be discontinued for one week, two weeks, three weeks or four weeks, and then resumed for at least one week. In further examples, after the first predetermined period of time, the soluble hyaluronidase is further administered to the subject more than once a week for a predetermined number of weeks in an amount sufficient to maintain a pharmacologically active level of the hyaluronidase in the plasma of at least about or 3 U/mL to prevent resynthesis of the substrate to levels prior to treatment. In some embodiments of any of these methods, the cycle of administration and discontinuation of administration is repeated a plurality of times.

In some embodiments of the methods provided herein, the hyaluronidase is administered in an amount sufficient to maintain a pharmacologically active level of the hyaluronidase in the plasma of at least or about 3 U/mL-12 U/mL. For example, the hyaluronidase can be administered in an amount sufficient to maintain a pharmacologically active level of the hyaluronidase in the plasma of at least at or about 5 U/mL, 6 U/mL, 7 U/mL, 8 U/mL, 9 U/mL, 10 U/mL, 15 U/mL, 20 U/mL, 30 U/mL, 40 U/mL, 45 U/mL, 50 U/mL or more. In a particular embodiment of the methods, the hyaluronidase is administered in an amount sufficient to maintain a pharmacologically active level of the hyaluronidase in the plasma of at least or about 10 U/mL.

In one embodiment of the methods for treating a disease or condition in which a hyaluronidase substrate accumulates, the hyaluronidase is administered twice a week. The amount of hyaluronidase administered to the subject can be, for example, 0.02 mg/kg (of the subject), 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg or more. In one example, the amount of hyaluronidase administered is 0.05 mg/kg-0.8 mg/kg. In further examples, the amount of hyaluronidase administered is or is about 50,000 Units (U); 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more.

Provided herein are methods for treating a hyaluronan-associated disease or condition in a subject. Such methods include the steps of (a) measuring hyaluronan expression or hyaluron in a sample from the subject; and (b) if the hyaluronan expression or hyaluron in the sample from the subject is elevated or at a level indicative of the disease or condition, administering a composition containing a soluble hyaluronidase to the subject. The soluble hyaluronidase used in these methods is modified by conjugation to a polymer. In some examples, the sample from the subject is a tissue or body fluid, such as, for example, a blood sample, tumor biopsy, cerebral spinal fluid, urine, sweat, semen or saliva sample.

In particular embodiments of the methods for treating a hyaluronan-associated disease or condition, a second and different agent for treating the disease or condition also is administered to the subject. In some examples, the second agent and the composition containing the soluble hyaluronidase are administered in a single composition. In other examples, the second agent and the composition containing the soluble hyaluronidase are administered separately, such as simultaneously, sequentially or intermittently in any order. In one embodiment, the second agent is administered after administration of the composition containing the soluble hyaluronidase. For example, the second agent can be administered after the first administration of the soluble hyaluronidase in the cycle of administration, and optionally after one or more subsequent administrations of the soluble hyaluronidase, such as after each subsequent administration of the soluble hyaluronidase, after every other subsequent administration of the soluble hyaluronidase, or once a week, once every two weeks, once every three weeks or once a month.

In some aspects of the methods for treating a hyaluronan-associated disease or condition provided herein, the second agent is administered at least 0.5 minutes, at least one minute, at least five minutes, at least fifteen minutes, at least thirty minutes, at least one hour or more than one hour after the composition containing the soluble hyaluronidase is administered. In some examples, the second agent is administered at least or two hours, four hours, six hours, eight hours, 10 hours, 12 hours, 14 hours, 16 hours, 18 hours, 20 hours, 22 hours or 24 hours after the composition containing the soluble hyaluronidase is administered. In one example, the second agent is administered at least forty-eight hours after the composition containing the soluble hyaluronidase. In another example, the second agent is administered at least seventy-two hours after the composition containing the soluble hyaluronidase. In further aspects of the methods provided herein for treating a hyaluronan-associated disease or condition, the expression of hyaluronan in the sample from the subject is compared to expression in a control sample or a standard.

The hyaluronidase used in the methods for treating a disease or condition in which a hyaluronidase substrate accumulates, and the methods for treating a hyaluronan-associated disease or condition, is conjugated to a polymer. In some examples, the polymer is a sialation or pegylation moiety. In some of the methods provided herein, a second agent is administered to the subject, as described above and herein. In some examples, the second agent is an anti-cancer agent or treatment, such as, for example, a chemotherapeutic agent, radiation therapy, an antibody, a peptide, a gene therapy vector, a virus or a nucleic acid. Exemplary of second agents that are used in some of the methods provided herein include anti-cancer agents, such as, for example, Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; Melphalans1L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars.

In any of methods for treating a disease or condition in which a hyaluronidase substrate accumulates and methods for treating a hyaluronan-associated disease or condition that are provided herein, the soluble hyaluronidase and/or second agent can be administered locally or systemically, such as, for example, orally, intravenously (IV), subcutaneously, intramuscularly, intra-tumorally, radermally, topically, transdermally, rectally or sub-epidermally. In particular examples of the methods provided herein, the soluble hyaluronidase and/or second agent is administered intravenously. In other examples, the soluble hyaluronidase and/or second agent is administered intra-tumorally.

Provided herein are methods for treating a disease or condition in which a hyaluronidase substrate accumulates and methods for treating a hyaluronan-associated disease or condition. In some examples, the disease or condition in which a hyaluronidase substrate accumulates is associated with high interstitial fluid pressure. In further examples, the disease or condition treated by the methods provided herein is disc pressure, cancer or edema. The edema, for example, can be caused by organ transplant, stroke or brain trauma. In instances where the disease or condition to be treated is cancer, the cancer can be a tumor, such as a solid tumor. In some examples, the tumor has increased cellular and/or stromal expression of a hyaluronan, compared to a non-cancerous tissue of the same tissue type or compared to a non-metastatic tumor of the same tumor-type. In particular examples, the disease or condition to be treated is a late-stage cancer, a metastatic cancer and/or an undifferentiated cancer. In one example, the disease or condition is ovarian cancer, in situ carcinoma (ISC), squamous cell carcinoma (SCC), prostate cancer, pancreatic cancer, non-small cell lung cancer, breast cancer, brain cancer or colon cancer. In some examples of the methods provided herein, the treatment effects a reduction in the size of a tumor in the subject.

In some embodiments, the soluble hyaluronidase used in the methods provided is a soluble PH20, including, but not limited to, an ovine, mouse, monkey, bovine, bacterial or human PH20. In some examples, the soluble form of PH20 is a soluble PH20 that has been truncated to remove a C-terminal GPI. In some aspects of the methods provided herein, the soluble hyaluronidase has a sequence of amino acids included in SEQ ID NO:1 or a sequence that has at least about 91% amino acid sequence identity with a sequence of amino acids included in SEQ ID NO:1, whereby the soluble hyaluronidase is soluble, N-glycosylated and neutral active. In other examples, the soluble hyaluronidase includes a sequence of amino acids set forth in SEQ ID NO:1 that is truncated at an amino acid residue that is or is between amino acid residues 467 to 483. For example, the soluble hyaluronidase can include a sequence of amino acids set forth in SEQ ID NO:1 that is truncated at an amino acid residue selected from among 467, 468, 469, 470, 471, 472, 473, 474, 475, 476, 477, 478, 479, 480, 481, 482 and 483.

In some aspects, the soluble hyaluronidase used in the methods provided herein is secreted in CHO cells. In other aspects, the soluble hyaluronidase has the sequence of amino acids set forth as amino acids 36-467, 36-468, 36-469, 36-470, 36-471, 36-472, 36-473, 36-474, 36-475, 36-476, 36-477, 36-478, 36-479, 36-480, 36-481, 36-482, or 36-483 of SEQ ID NO:1, or has at least about 91% amino acid sequence identity with a sequence of amino acids set forth as amino acids 36-467, 36-468, 36-469, 36-470, 36-471, 36-472, 36-473, 36-474, 36-475, 36-476, 36-477, 36-478, 36-479, 36-480, 36-481, 36-482, or 36-483 of SEQ ID NO:1. In particular examples, the soluble hyaluronidase is selected from among polypeptides containing a sequence of amino acids set forth in any of SEQ ID NOS: 4-9 and 46-48, and allelic variants, species variants and other variants thereof. In one embodiment, the soluble hyaluronidase is a polypeptide encoded by a sequence of nucleic acids that encodes a sequence of amino acids set forth in SEQ ID NO:4. In another embodiment, the soluble hyaluronidase is selected from among polypeptides encoded by a sequence of nucleic acids that encodes a sequence of amino acids set forth in any of SEQ ID NOS: 4-9. In such instances, the soluble hyaluronidase can be produced by expression in CHO cells. For example, in one embodiment, the soluble hyaluronidase is designated rHuPH20. Further, in some aspects, the soluble hyaluronidase used in the methods provided herein is glycosylated.

As discussed above, in the methods provided herein for treating a disease or condition in which a hyaluronidase substrate accumulates or for treating a hyaluronan-associated disease or condition, a hyaluronidase enzyme that is modified by conjugation to a polymer is administered to a subject. In some examples, the polymer conjugated to the soluble hyaluronidase contains a pegylation moiety (PEG), such as, for example, methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly (ethylene glycol)-propionaldehyde (PEG-propionaldehyde) (30 kDa). In some aspects, the PEG is a branched or linear PEG. In a particular example, the PEG is a methoxy-PEG (mPEG), or example, a linear N-hydroxysuccinimidyl ester of methoxy poly(ethylene glycol) butanoic acid. Such PEGs can have a molecular weight of 30 or about 30 kilodaltons.

Provided herein are compositions containing a soluble hyaluronidase in an amount sufficient for maintaining a plasma level of the hyaluronidase enzyme in plasma at a level of at least 3 U/mL for at least a week, wherein the soluble hyaluronidase is conjugated to a polymer. In some aspects, the level of hyaluronidase in the plasma is at least or about 3 U/mL-12 U/mL. Exemplary polymers conjugated to the hyaluronidase include, but are not limited to, sialation and pegylation moieties. The compositions can be administered at least twice a week for more than at least one week. In some examples, the composition contains at least or about 2.0 mg-60 mg of the soluble hyaluronidase conjugated to a polymer, and the soluble hyaluronidase conjugated to a polymer has a specific activity of at least or about 20,000 U/mg, 25,000 U/mg, 30,000 U/mg, 31,000 U/mg, 32,000 U/mg, 33,000 U/mg, 34,000 U/mg, 35,000 U/mg, 36,000 U/mg, 37,000 U/mg, 38,000 U/mg, 39,000 U/mg, 40,000 U/mg, 45,000 U/mg, 50,000 U/mg, 55,000 U/mg, 60,000 U/mg or more. Further, in some aspects, the composition is at least 10 mL/per administration.

The compositions provided herein can be formulated for administration orally, intravenously (IV), subcutaneously, intramuscularly, intra-tumorally, radermally, topically, transdermally, rectally or sub-epidermally. In one example, the composition is formulated for intravenous administration. The compositions provided herein also can contain histidine and/or NaCl. For example, in one embodiment, the composition is formulated with at or about 10 mM histidine and/or 130 mM NaCl. The composition can have a pH that is or is about 6.0, 6.1, 6.2, 6.3, 6.4, 6.5, 6.6, 6.7, 6.8, 6.9, 7.0, 7.1 or 7.2. In one example, the composition has a pH of or about 6.5.

Provided herein are combinations containing a composition containing a soluble hyaluronidase in an amount sufficient for maintaining a plasma level of the hyaluronidase enzyme in plasma at a level of at least 3 U/mL for at least a week, wherein the soluble hyaluronidase is conjugated to a polymer, and a second composition containing an agent for treating a hyaluronan-associated disease or condition. In some examples, the composition containing a soluble hyaluronidase is for administration at least twice a week for more than at least one week. In further aspects, the composition containing a soluble hyaluronidase contains at least or about 2.0 mg-60 mg of the soluble hyaluronidase conjugated to a polymer; and the soluble hyaluronidase conjugated to a polymer has a specific activity of at least or about 20,000 U/mg, 25,000 U/mg, 30,000 U/mg, 31,000 U/mg, 32,000 U/mg, 33,000 U/mg, 34,000 U/mg, 35,000 U/mg, 36,000 U/mg, 37,000 U/mg, 38,000 U/mg, 39,000 U/mg, 40,000 U/mg, 45,000 U/mg, 50,000 U/mg, 55,000 U/mg, 60,000 U/mg or more.

The first and second compositions of the combinations provided herein are co-formulated or provided separately. In some examples, the polymer conjugated to the hyaluronidase in the combinations provided herein is a sialation or pegylation moiety. In further embodiments, the second agent in the combination is an anti-cancer agent or treatment, such as, for example, a chemotherapeutic agent, radiation therapy an antibody, a peptide, a gene therapy vector, a virus or a nucleic acid. In particular examples, the second agent is an anti-cancer agent selected from among Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; Melphalans1L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars.

In one method, a composition containing a modified hyaluronan degrading enzyme is administered to a subject who has a hyaluronan-associated disease or condition or who may have such disease or condition, followed by administering a second and different agent or treatment for treating the disease or condition. The second agent or treatment is administered more than twenty-four hours after administration of the hyaluronan degrading enzyme. Administration can be effected systemically or locally or by any suitable route, such as intravenously, orally, subcutaneously or intramuscularly.

In another method for treating a hyaluronan-associated disease or condition in a subject, a composition containing modified hyaluronan degrading enzyme is systemically administered to a subject who has a hyaluronan-associated disease or condition or who may have such disease or condition. The modified hyaluronan degrading enzyme is administered in at least an amount that is effective to decrease interstitial fluid pressure for more than 24 hours. Administration of the hyaluronan degrading enzyme can treat the disease or condition or can be followed by or administered with a second agent or treatment. Administration can be effected intravenously, orally, subcutaneously or intramuscularly, including, for example, intra-tumorally.

Also provided are methods for lowering interstitial fluid pressure in a subject by administering to the subject a composition containing an effective amount of a hyaluronan degrading enzyme that is modified. The amount of hyaluronan degrading enzyme lowers interstitial fluid pressure for more than 24 hours; and the amount of hyaluronan degrading enzyme is functionally equivalent to between at or about 10 units to 1,000,000 hyaluronidase units, such as at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units. Units are measured generally with reference to the unmodified hyaluronidase. Lowering interstitial pressure can effect treatment of a hyaluronan-associated disease or condition in a subject.

In practicing any of the methods herein, hyaluronan expression in a sample from the subject can be measured (or assessed or monitored) prior to, during or after treatment. If needed, expression of hyaluronan in a sample from the subject can be compared to expression in a control sample or to a standard. Thus provided, for example, are methods for treating a hyaluronan-associated disease or condition in a subject by first measuring hyaluronan expression in a sample from the subject; and then administering a composition containing a modified hyaluronan degrading enzyme to the subject. Administration includes local and systemic administration, such as but not limited to, orally, intravenously (IV), subcutaneously, intramuscularly, intra-tumorally, intradermally, topically, transdermally, orally, rectally or sub-epidermally. The sample, for example, is a tissue or body fluid, such as but not limited to, a blood sample, tumor biopsy, cerebral spinal fluid, urine, sweat, semen or saliva sample.

The methods can be practiced by administering a second agent or treatment that is, other than a hyaluronan degrading enzyme, and that is used for treatment of a particular disease. For example, if the disease is a tumor, then the second agent can be a chemotherapeutic and or radiation protocol/therapy. Exemplary second agents are anti-cancer agents.

Where the second agent is a drug or composition, the second agent and hyaluronidase can be administered separation, together in a single composition or simultaneously in two compositions, or intermittently or sequentially or any combination thereof. Typically, the composition containing a hyaluronan degrading enzyme is administered prior to administration of the second agent. In some embodiments, the second agent or treatment can be effected or administered before the hyaluronidase-containing compositions. In methods in which the time is not required herein to be more than 24 hours, the timing between administration of the composition containing a soluble hyaluronidase and the second agent or treatment can be within 30 seconds or 60 seconds, at least one minute, at least five minutes, at least fifteen minutes, at least thirty minutes at least one hour or more than one hour prior to (or subsequent to). The time difference can be least or two hours, four hours, six hours, eight hours, 10 hours, 12 hours, 14 hours, 16 hours, 18 hours, 20 hours, 22 hours, 24 hours, 48 hours or 72 hours prior to administration of the second agent or treatment.

Exemplary second agents and treatments include, for example, anticancer agents are a chemotherapeutic agent, radiation therapy, an antibody, a peptide, a gene therapy vector, a virus, such as an oncolytic virus, and a nucleic acids, such as gene therapy vectors that deliver an anticancer protein or other therapeutic protein. Other exemplary second agents or treatments include, but are not limited to, an analgesic agent, an anti-inflammatory agent, an antimicrobial agent, an amoebicidal agent, a trichomonocidal agent, an anti-parkinson's disease agent, an anti-malarial agent, an anticonvulsant agent, an anti-depressant agent, an anti-arthritis agent, an anti-fungal agent, an antihypertensive agent, an antipyretic agent, an anti-parasitic agent, an antihistamine agent, an alpha-adrenergic agonist agent, an alpha blocker agent, an anesthetic agent, a bronchial dilator agent, a biocide agent, a bactericide agent, a bacteriostatic agent, a beta adrenergic blocker agent, a calcium channel blocker agent, a cardiovascular drug agent, a contraceptive agent, a cosmetic or aesthetic agent, a decongestant agent, a diuretic agent, a depressant agent, a diagnostic agent, a therapeutic antibody, an electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sleep inducer, a sympathomimetic agent, a tranquilizer agent, a urinary agent, a vaginal agent, a viricide agent, a vitamin agent, a non-steroidal anti-inflammatory agent, and an angiotensin converting enzyme inhibitor agent. Exemplary of such agents are: Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; Melphalans1L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars.

Hyaluronan-associated diseases or conditions include, for example, diseases or conditions associated with or including high interstitial fluid pressure, such as disc pressure, cancer and edema. Edema can result from or be manifested in, for example, from organ transplant, stroke or brain trauma. Cancers, include solid and lymphatic/blood tumors and metastatic disease, and undifferentiated tumors. The tumors amenable to treatment typically exhibit cellular and/or stromal expression of a hyaluronan, compared to a non-cancerous tissue of the same tissue type or compared to a non-metastatic tumor of the same tumor-type. Cancers include any one or more of ovarian cancer, in situ carcinoma (ISC), squamous cell carcinoma (SCC), prostate cancer, pancreatic cancer, other gastric cancers, non-small cell lung cancer, breast cancer, brain cancer and colon cancer.

As noted, the hyaluronan degrading enzymes for use in the methods, compositions and combinations herein, include soluble hyaluronidases, including non-human animal hyaluronidases, bacterial hyaluronidases and human hyaluronidases. Exemplary of soluble hyaluronidases are soluble active portions of PH20, such as ovine, bovine, and human PH20. To render the PH20 soluble, such as human PH20, the PH20 is truncated to remove a C-terminal GPI anchor attachment signal sequence. With reference to human PH20, truncation ends at any of residues 467-482 or corresponding to any of residues 467-482 of SEQ ID NO:1 in the human, allelic or species variants or other variants. For example, the hyaluronan degrading enzyme can be selected from among polypeptides containing a sequence of amino acids set forth in any of SEQ ID NOS: 4-9 and 47-48, and allelic variants, species variants and other variants thereof. The hyaluronan degrading enzyme can be one that is encoded by a sequence of nucleic acids that encodes a sequence of amino acids set forth in SEQ ID NO:3 or any of SEQ ID NOS: 4-9 and 47-48, such as the sequence of nucleic acids set forth in SEQ ID NO: 49. They can be the hyaluronan degrading enzymes that have such sequences of amino acids. The hyaluronan degrading enzyme is selected from among the other variants thereof. The other variants are selected from among polypeptides having at least 60%, 65, 70, 75, 80, 85, 88%, 90, 91, 92, 93, 94, 95, 96, 97, 98, 99% or more sequence identity along their full length to a contiguous sequence of amino acids from the that set forth in SEQ ID NO:1, 4-9 and 47-48 as long as the polypeptide is soluble and exhibits hyaluronidase activity (i.e. can degrade hyaluronan), which can be assessed by methods known to one of skill in the art, including methods described herein.

In particular, the hyaluronan degrading enzyme can be polypeptide that is produced by expression of the nucleic acid molecule that encodes amino acids 1-482 or 36-482 (i.e., as set forth in SEQ ID NO:1) of the human PH20 soluble hyaluronidase or allelic or species or other variants thereof. Expression can include expression and secretion in cells, such as CHO cells. For example, the composition is designated recombinant human PH20 (rHuPH20), which is produced by expression of nucleic acid encoding amino acids 36-482, linked to nucleic acid encoding a signal sequence for secretion, such as amino acids 1-35, in CHO cells. rHuPH20 is isolated from the medium. Following isolation it is modified, such as by reaction with one or more pegylation moieties. (PEG) or other polymer. Other hyaluronan degrading enzymes can be similarly modified and can be produced by recombinant expression or isolated from natural sources. Such methods and products are known to those of skill in the art.

Exemplary polymers for modification of the hyaluronan degrading enzyme include, but are not limited to, methoxy-poly(ethylene glycol)-succinimidyl butanoate (mPEG-SBA)

(5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$-N-hydroxysuccinimide ester (mPEG$_2$-NHS) (40 kDa branched); (methoxy-poly(ethylene glycol))$_2$-N-hydroxysuccinimide ester (mPEG$_2$-NHS) (60 KDa branched); biotin-poly(ethylene glycol)-N-hydroxysuccinimide ester (biotin-PEG-NHS) (5 KDa biotinylated); poly(ethylene glycol)-p-nitrophenyl carbonate (PEG-p-nitrophenyl-carbonate) (30 kDa); and poly(ethylene glycol)-propionaldehyde (PEG-propionaldehyde) (30 kDa).

PEG moieties are well known, and include those that are commercially available or that can be synthesized. PEG moieties can be branched or linear PEG, such as a methoxy-PEG (mPEG), including, for example, a linear N-hydroxy-succinimidyl ester of methoxy poly(ethylene glycol) butanoic acid. The molecular weight of the PEG can be anything suitable, such as 30 or about 30 kilodaltons.

When the hyaluronan degrading enzyme is modified, the specific activity can be reduced. To compensate, a greater amount (weight) of the modified species is employed. For example, the specific activity of a PEGylated rHuPH20 can be 2- or 3- or 4-fold less or about 2- or 3- or 4-fold less than the specific activity of a native rHuPH20. Dosages are adjusted accordingly to deliver the desired units. Dosages depend upon the disease or condition and particular hyaluronan degrading enzyme, such as the particular hyaluronidase, and modification thereof. Typical dosages are at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units of soluble hyaluronidase. In instances where the hyaluronan degrading enzyme is not a hyaluronidase, typical dosages are functionally equivalent to at or about 10 to 50,000,000 hyaluronidase Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 hyaluronidase Units. Such dosages are selected to or can be used to effect at least a 25%, about 25%, 50% or about 50% decrease of interstitial fluid pressure in a tissue of the subject, which can be maintained for more than about or 1 or 2 hours, or at least 8 or at least about 8 hours, at least 24 or at least about 24 hours, at least 48 or at least about 48 hours or at least 72 or at least about 72 hours, following the administration.

Administration of the modified hyaluronan degrading enzyme composition, such as a modified hyaluronidase composition, can effect changes in vascular volume, such as in a tumor. Such changes can be at least 2-fold or about 2-fold or at least 3-fold or about 3-fold increase in the vascular volume of a tissue in the subject. Administration of the composition containing a hyaluronan degrading enzyme can effect at least a 25% or about 25% or at least a 50% or about 50% reduction in water content in a tissue of the subject. These changes can be maintained or manifested for at least 8 or about 8 hours, at least 24 or about 24 hours, at least 48 or about 48 hours, or at least 72 or about 72 hours following administration of the composition containing the hyaluronan degrading enzyme.

Administration of the composition containing a hyaluronan degrading enzyme can effect a decrease in the percentage of hyaluronan positive cells in a tissue of the subject. The hyaluronan-positive cells can occur in a tumor, such as a solid tumor. Treatment can effect a reduction in the size of a tumor in the subject.

Administration of the composition containing a hyaluronan degrading enzyme can be manifested and/or observed as a hyaluronidase activity in the blood of the subject. The half-life of the hyaluronidase in the blood of the subject is at least 1 or about 1, 5 or about 5, 8 or about 8, 10 or about 10, 15 or about 15, 24 or about 24, 48 or about 48, or 72 or about 72 hours. For example, where the administration of the composition containing a hyaluronan degrading enzyme results in hyaluronidase activity in the blood of the subject, one milliliter of plasma from the subject has at least 5% or about 5% of the total hyaluronidase activity administered to the patient for at least 1 or about 1, 5 or about 5, 8 or about 8, 10 or about 10, 15 or about 15, 24 or about 24, 48 or about 48, or 72 or about 72 hours.

Also provided are combinations that contain:
a first composition containing an effective amount of a hyaluronan degrading enzyme for lowering interstitial fluid pressure, where the amount lowers interstitial fluid pressure for more than 24 hours; and an amount of hyaluronan degrading enzyme is functionally equivalent to between at or about 10 to 1,000,000, about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 hyaluronidase; and a second composition containing an agent for treating a hyaluronan-associated disease or condition.

The hyaluronan degrading enzymes are modified by conjugation to a polymer, such as one that increases half-life of the hyaluronidase. Exemplary polymers, include dextran, a sialation or pegylation moiety and/or combinations thereof. The hyaluronan degrading enzymes can be soluble hyaluronidases, which can include those selected from among non-human animal hyaluronidases, human hyaluronidases and bacterial hyaluronidases as described above, and include the soluble hyaluronidase is a soluble form of a PH20 described above for use in the methods. The second agent or treatment includes any set forth above for use in the methods.

By virtue of methods herein, cancers and other diseases that contain pericellular matrices that rich in proteoglycans that contain hyaluronan are treated. Such cancers and other diseases are amenable to treatment with modified soluble hyaluronidases and other agents as described herein (above and below). As detailed herein, contact with a modified hyaluronan degrading enzyme, such pegylated rHuPH20, results in collapse of the pericellular coats. As exemplified pegylated rHuPH20 (PEGrHuPH20) reduced tumor IFP in a dose dependent fashion, achieving more than 85% reduction in IFP following IV administration. Peritumoral HA remained depleted over 3 days after a single dose of PEGrH-uPH20. Along with histologic collapse of pericellular hyaluronan surrounding the tumor cells, tumor water content significantly decreased over 3 days, consistent with changes detected in the tumor by Apparent Diffusion Coefficient (ADC) MRI and IFP monitoring. Furthermore, as exemplified a 3.5-fold selective increase in tumor vascular volume was achieved within 8 hours post-dosing as a result of vascular decompression of blood vessels within the tumor. This was confirmed by histology and ultrasound. Such hyaluronan in the tumor microenvironment can be targeted with soluble modified hyaluronidases, such as pegylated rHuPH20 (PEGrHuPH20). As exemplified also, co-administration of pegylated rHuPH20 with a chemotherapeutic agent, such as docetaxel or liposomal doxorubicin, can increase the anti-tumor activity of the chemotherapeutic agent in animal models compared to when the chemotherapeutic agent is administered alone.

DETAILED DESCRIPTION

Figure 1:
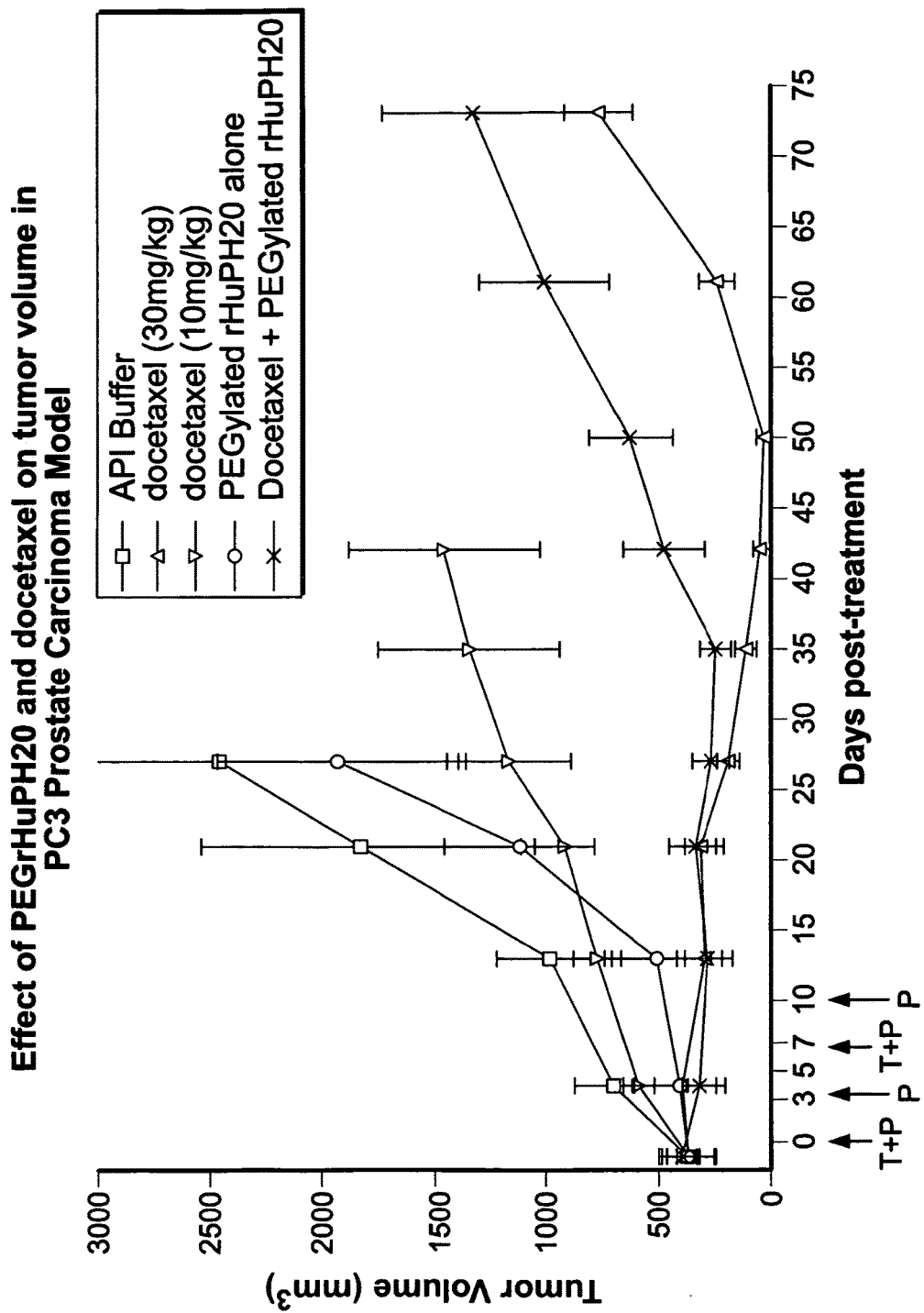
FIG. 1 depicts the tumor volume in nude mice inoculated intramuscularly with human PC3 prostate cancer cells to establish tumors (PC3 Prostate Carcinoma Model). Following inoculation, the mice were subjected to treatment regimens in which doses of either active pharmaceutical ingredient (API) buffer, 30 mg/kg docetaxel, 10 mg/kg docetaxel, PEGylated rHuPH20 (P) or PEGylated rHuPH20 plus 10 mg/kg docetaxel (T+P) were administered. The tumor volumes were measured at various time points to assess the effect of co-administration of PEGylated rHuPH20 with docetaxel on the anti-tumor activity of docetaxel.

Outline
A. DEFINITIONS
B. OVERVIEW OF THE METHODS AND COMPOSITIONS FOR TREATING HYALURONAN-ASSOCIATED CONDITIONS, DISEASES AND DISORDERS
  1. Hyaluronan
  2. Hyaluronan-associated Diseases
  3. Methods of Treatment and Compositions
  4. Combinations and Methods of treatment Thereof
C. COMPOSITIONS CONTAINING HYALURONAN DEGRADING ENZYMES
  1. Hyaluronidases
    a. Mammalian-type hyaluronidases
    b. Bacterial hyaluronidases
    c. Hyaluronidases from leeches, other parasites and crustaceans
  2. Other hyaluronan degrading enzymes
  3. Soluble hyaluronan degrading enzymes
    a. Soluble Human PH20
    b. rHuPH20
  4. Glycosylation of hyaluronan degrading enzymes
  5. Modified (Polymer-Conjugated) hyaluronan degrading enzymes
    a. PEGylated Soluble hyaluronan degrading enzymes
D. METHODS OF PRODUCING NUCLEIC ACIDS ENCODING A HYALURONAN DEGRADING ENZYME AND POLYPEPTIDES THEREOF
  1. Vectors and cells
  2. Expression
    a. Prokaryotic Cells
    b. Yeast Cells
    c. Insect Cells
    d. Mammalian Cells
    e. Plants
  3. Purification Techniques
  4. PEGylation of Hyaluronan degrading enzyme polypeptides
F. PREPARATION, FORMULATION AND ADMINISTRATION OF COMPOSITIONS
  1. Formulations
    a. Injectables, solutions and emulsions
    b. Lyophilized powders
    c. Topical administration
    d. Compositions for other routes of administration
  2. Dosage and Administration
  3. Combination Therapies
  4. Packaging and Articles of Manufacture
G. METHODS OF ASSESSING ACTIVITY, BIOAVAILABILITY AND PHARMACOKINETICS
  1. Assays to assess the activity of hyaluronan degrading enzymes
  2. Pharmacokinetics and tolerability
  3. Animal models
H. USE OF HYALURONAN DEGRADING ENZYMES IN TREATING HYALURONAN-ASSOCIATED CONDITIONS, DISEASES AND DISORDERS
  1. Hyaluronan-associated conditions and diseases Cancers, including hyaluronan-rich cancers
  2. Uses in Treating Hyaluronan-associated conditions and diseases
    a. Detection of hyaluronan-associated disease markers (selection of subjects for treatment and assessing treatment effects)
      i. Assays for detection of hyaluronan-associated disease markers
      ii. Detection of hyaluronan-associated markers relative to control samples
    b. Use in treating cancers Anti-Cancer Agents and Other Treatments
    c. Use in treating other diseases associated with elevated interstitial fluid pressure
  3. Use as a spreading agent
  4. Use in hypodermoclysis
  5. Application on vitrectomy and ophthalmic disorders and conditions
  6. Gene therapy applications
  7. Cosmetic uses
  8. Use in organ transplantation
  9. Use in treatment of glycosaminoglycan accumulation in the brain
  10. Use in treatment of glycosaminoglycan accumulation in cardiovascular disease
  11. Use in pulmonary disease
  12. Other uses
I. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, dosing regime refers to the amount of agent, for example, the composition containing a soluble hyaluronidase or other agent, administered, and the frequency of administration. The dosing regime is a function of the disease or condition to be treated, and thus can vary.

As used herein, frequency of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is function of the particular disease or condition treated. Generally, frequency is more than once weekly, and generally is twice weekly.

As used herein, a "cycle of administration" refers to the repeated schedule of the dosing regime of administration of the enzyme and/or a second agent that is repeated over successive administrations. For example, an exemplary cycle of administration is a 28 day cycle with administration twice weekly for three weeks, followed by one-week of discontinued dosing.

As used herein, "predetermined" with reference to a number of weeks of administration or discontinued administration refers to a period of time that is decided or established in advance. The period of time can be empirically determined and is a function of the disease or condition, the severity of the condition, the particular patient and other factors within the level of skill of a treating physician.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Flavobacterium heparinum Victivallis vadensis*, set forth in SEQ ID NO:99, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251: 1154-8; Tsuda et al. (1999) *Eur. J. Biochem.* 262:127-133).

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), chimpanzee (SEQ ID NO:101), Rhesus monkey (SEQ ID NO:102), orangutan (SEQ ID NO:28), cynomolgus monkey (SEQ ID NO:29), guinea pig (SEQ ID NO:30), *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES 114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases Vitrase® (ovine hyaluronidase) and Amphadase® (bovine hyaluronidase).

Reference to hyaluronan degrading enzymes includes precursor hyaluronan degrading enzyme polypeptides and mature hyaluronan degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-102, or the mature form thereof. For example, reference to hyaluronan degrading enzyme also includes the human PH20 precursor polypeptide variants set forth in SEQ ID NOS:50-51. Hyaluronan degrading enzymes also include those that contain chemical or post-translational modifications and those that do not contain chemical or posttranslational modifications. Such modifications include, but are not limited to, pegylation, albumination, glycosylation, farnysylation, carboxylation, hydroxylation, phosphorylation, and other polypeptide modifications known in the art.

As used herein, a soluble hyaluronidase refers to a polypeptide characterized by its solubility under physiologic conditions. Soluble hyaluronidases can be distinguished, for example, by its partitioning into the aqueous phase of a Triton X-114 solution warmed to 37° C. (Bordier et al., (1981) J. Biol. Chem., 256:1604-7). Membrane-anchored, such as lipid anchored hyaluronidases, will partition into the detergent rich phase, but will partition into the detergent-poor or aqueous phase following treatment with Phospholipase-C. Included among soluble hyaluronidases are membrane anchored hyaluronidases in which one or more regions associated with anchoring of the hyaluronidase to the membrane has been removed or modified, where the soluble form retains hyaluronidase activity. Soluble hyaluronidases include recombinant soluble hyaluronidases and those contained in or purified from natural sources, such as, for example, testes extracts from sheep or cows. Exemplary of such soluble hyaluronidases are soluble human PH20. Other soluble hyaluronidases include ovine (SEQ ID NOS:27, 63, 65) and bovine (SEQ ID NOS:11, 64) PH20.

As used herein, soluble human PH20 or sHuPH20 include mature polypeptides lacking all or a portion of the glycosylphosphatidylinositol (GPI) attachment site at the C-terminus such that upon expression, the polypeptides are soluble. Exemplary sHuPH20 polypeptides include mature polypeptides having an amino acid sequence set forth in any one of SEQ ID NOS:4-9 and 47-48. The precursor polypeptides for such exemplary sHuPH20 polypeptides include a signal sequence. Exemplary of the precursors are those set forth in SEQ ID NOS:3 and 40-46, each of which contains a 35 amino acid signal sequence at amino acid positions 1-35. Soluble HuPH20 polypeptides also include those degraded during or after the production and purification methods described herein.

As used herein, soluble recombinant human PH20 (rHuPH20) refers to a soluble form of human PH20 that is recombinantly expressed in Chinese Hamster Ovary (CHO) cells. Soluble rHuPH20 is encoded by nucleic acid that includes the signal sequence and is set forth in SEQ ID NO:49. Also included are DNA molecules that are allelic variants thereof and other soluble variants. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NOS. 4-9 in various abundance. Corresponding allelic variants and other variants also are included, including those corresponding to the precursor human PH20 polypeptides set forth in SEQ ID NOS:50-51. Other variants can have 60%, 70%, 80%, 85%, 90%, 91%, 92%, 93%, 94%, 95%, 96%, 97%, 98%, 99% or more sequence identity with any of SEQ ID NOS.4-9 and 47-48 as long they retain a hyaluronidase activity and are soluble.

As used herein, a hyaluronidase substrate refers to a substrate (e.g. protein or polysaccharide) that is cleaved and/or depolymerized by a hyaluronidase enzyme. Generally, a hyaluronidase substrate is a glycosaminoglycan. An exemplary hyaluronidase substrate is hyaluronan (HA).

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing a hyaluronan degrading enzyme, such as a hyaluronidase, for example, a soluble hyaluronidase, either alone or in combination with or in addition to another treatment and/or agent. Exemplary diseases and conditions, include, but are not limited to, hyaluronan-rich cancers, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, elevated hyaluronan levels refers to amounts of hyaluronan in particular tissue, body fluid or cell, dependent upon the disease or condition. consequence or otherwise observed in the disease. For example, as consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease.

As used herein, a polymer that is conjugated to a hyaluronan degrading enzyme, such as a hyaluronidase, refers to any polymer that is covalently or otherwise stably linked, directly or via a linker, to a hyaluronan degrading enzyme. Such polymers, typically increase serum half-life, and include, but are not limited to sialic moieties, pegylation moieties, dextran, and sugar and other moieties, such as for glycosylation.

As used herein, a native hyaluronan degrading enzyme, e.g. a native soluble hyaluronidase, is a hyaluronan degrading enzyme that has not been modified with a polymer, for example, a pegylation moiety (PEG) or sialation moiety. Hence, a native hyaluronan degrading enzyme is unmodified. Typically, native hyaluronan degrading enzymes, such as native soluble hyaluronidases, have decreased half-life in a biological environment (e.g. in a subject) compared to hyaluronan degrading enzymes that have been modified by conjugation of a polymer, e.g. PEG.

As used herein, specific activity refers to Units of activity per mg protein. The milligrams of hyaluronidase is defined by the absorption of a solution of at 280 nm assuming a molar extinction coefficient of approximately 1.7, in units of $M^{-1} cm^{-1}$.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, hyaluronidase activity refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as soluble rHuPH20, are known in the art and described herein. Exemplary assays include the microturbidity assay described below (see e.g. Example 3) that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, a unit of activity of a hyaluronidase refers to a U.S.P. National Formulary (NF XIII) unit (NFU), as determined by comparing to standard hyaluronidase samples (e.g., USP or WHO standard), for example, using the turbidity reducing ELISA-based assay described in Example 2 herein, whereby turbidity reducing units are related to the NFU, and U.S.P. unit through a standard curve of a sample of hyaluronidase (e.g., USP or WHO standard) standardized through the U.S.P. Thus, the enzyme activities as determined in Example 2 are relative TRU (see, for example, Dorfman et al., 1948, J. Biol. Chem. 172:367). A hyaluronidase unit is normalized to the standard activity. Hence, for example, a pegylated hyaluronidase can exhibit lower activity/mg. For purposes herein, dosages reference units. Units/mg (standard activity) of a particular modified hyaluronidase can be determined empirically if needed.

As used herein, "functionally equivalent amount" or grammatical variations thereof, with reference to a hyaluronan degrading enzyme, refers to the amount of hyaluronan degrading enzyme that achieves the same effect as an amount of a reference enzyme, such as a hyaluronidase. For example, the activity of any hyaluronan degrading enzyme can be compared to the activity of rHuPH20 to determine the functionally equivalent amount of a hyaluronan degrading enzyme that would achieve the same effect as a known amount of rHuPH20. For example, the ability of a hyaluronan degrading enzyme to act as a spreading or diffusing agent can be assessed by injecting it into the lateral skin of mice with trypan blue (see e.g. U.S. Pat. Publication No. 20050260186), and the amount of hyaluronan degrading enzyme required to achieve the same amount of diffusion as, for example, 100 units of a Hyaluronidase Reference Standard, can be determined. The amount of hyaluronan degrading enzyme required is, therefore, functionally equivalent to 100 units. In another example, the ability of a hyaluronan degrading enzyme to increase the in vivo activity of a co-administered agent (e.g. the anti-tumor activity of a chemotherapeutic agent) can be assessed in animal models or human subjects, such as described in Example 14, and the amount of hyaluronan degrading enzyme required to achieve the same increase in the activity of the co-administered agent as, for example, the administered quantity of rHuPH20, can be determined.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. □§§ 1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§ 1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Atschul, S. F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman ((1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, modification, when used in reference to modification of a sequence of amino acids, is used to describe modifications of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight) 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include other regulatory sequences, such as, but not limited to, one or more origins of replication, one or more selectable markers, an enhancer and a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates in the promoter and proceeds through the coding segment to the terminator.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomassie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity) a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, a kit is a packaged combination that optionally includes other elements, such as additional reagents and instructions for use of the combination or elements thereof.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a pharmaceutically effective agent, includes any therapeutic agent or bioactive agents, including, but not limited to, for example, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass hyaluronan degrading enzyme, such as hyaluronidase, and second agent compositions contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of compositions provided herein and another item for a purpose including, but not limited to, activation, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The enzymes provided herein are from any source, animal, plant, prokaryotic and fungal. Most enzymes are of animal origin, including mammalian origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, anti-cancer treatments include administration of drugs and other agents for treating cancer, and also treatment protocols, such as radiation.

As used herein, a therapeutic antibody, refers to any antibody use for therapy, and includes, but is not limited to monoclonal antibodies, human antibodies, scFvs, diabodies, Fabs, and other fragments of antibodies.

As used herein, antibody fragment refers to any derivative of an antibody that is less than full length, retaining at least a portion of the full-length antibody's specific binding ability. Examples of antibody fragments include, but are not limited to, Fab, Fab', F(ab)2, single-chain Fvs (scFv), Fv, dsFv, diabody and Fd fragments. The fragment can include multiple chains linked together, such as by disulfide bridges. An antibody fragment generally contains at least about 50 amino acids and typically at least 200 amino acids.

As used herein, an Fv antibody fragment is composed of one variable heavy domain (VH) and one variable light (VL) domain linked by noncovalent interactions.

As used herein, a dsFv refers to an Fv with an engineered intermolecular disulfide bond, which stabilizes the VH-VL pair.

As used herein, an $F(ab)_2$ fragment is an antibody fragment that results from digestion of an immunoglobulin with pepsin at pH 4.0-4.5; it can be recombinantly produced.

As used herein, an Fab fragment is an antibody fragment that results from digestion of an immunoglobulin with papain; it can be recombinantly produced.

As used herein, scFvs refers to antibody fragments that contain a variable light chain (VL) and variable heavy chain (VH) covalently connected by a polypeptide linker in any order. The linker is of a length such that the two variable domains are bridged without substantial interference. Exemplary linkers are (Gly-Ser)n residues with some Glu or Lys residues dispersed throughout to increase solubility.

As used herein, hsFv refers to antibody fragments in which the constant domains normally present in an Fab fragment have been substituted with a heterodimeric coiled-coil domain (see, e.g., Arndt et al. (2001) J Mol. Biol. 7:312:221-228).

As used herein, diabodies are dimeric scFv; diabodies typically have shorter peptide linkers than scFvs, and they preferentially dimerize.

As used herein, humanized antibodies refer to antibodies that are modified to include "human" sequences of amino acids so that administration to a human does not provoke an immune response. Methods for preparation of such antibodies are known. For example, the hybridoma that expresses the monoclonal antibody is altered by recombinant DNA techniques to express an antibody in which the amino acid composition of the non-variable regions is based on human antibodies. Computer programs have been designed to identify such regions.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. OVERVIEW OF THE METHODS AND COMPOSITIONS FOR TREATING HYALURONAN-ASSOCIATED CONDITIONS, DISEASES AND DISORDERS

Provided herein are methods, compositions and combinations for treating hyaluronan associated conditions, diseases and disorders. The methods, compositions and combinations provided herein employ hyaluronan degrading enzymes that can degrade hyaluronic acid (also called hyaluronan), which is an essential component of the extracellular matrix and a major constituent of the interstitial barrier. Many diseases and conditions are associated with accumulated expression or overexpression of a hyaluronidase substrate such as hyaluronan, which contributes to the progression and/or severity of the disease or condition. Hence, administration of such enzymes for the purposes of depolymerizing the substrate can result in the treatment of such diseases and conditions.

Any hyaluronan degrading enzyme, including any variant thereof (e.g. truncated variant), can be used herein provided the enzyme exhibits enzymatic activity. Generally, the hyaluronan degrading enzymes are modified by conjugation to a polymer (e.g. PEG) to increase the half-life of the enzyme. The increased half-life can increase systemic hyaluronidase activity and sustained duration of action for hyaluronan degradation. In addition, the increased half-life also can contribute to the prevention of resynthesis and regeneration of the hyaluronidase substrate associated with the disease or condition. For example, as described herein, a modified hyaluronan degrading enzyme that exhibits an increased half-life by virtue of conjugation to a polymer can prevent hyaluronan regeneration within tumors. The modified hyaluronan degrading enzymes provided herein also can be combined and/or co-formulated with a second agent for treating the hyaluronan associated conditions, diseases and/or disorders.

1. Hyaluronan

Glycosaminoglycans (GAGs) are complex linear polysaccharides of the extracellular matrix (ECM). GAGs are characterized by repeating disaccharide structures of an N-substituted hexosamine and an uronic acid, (e.g. hyaluronan (HA), chondroitin sulfate (CS), chondroitin (C), dermatan sulfate (DS), heparan sulfate (HS), heparin (H)), or a galactose (e.g. keratan sulfate (KS)). Except for HA, all exist covalently bound to core proteins. The GAGs with their core proteins are structurally referred to as proteoglycans (PGs).

HA is a linear, repeating polysaccharide made up of N-acetylglucosamine and glucuronic acid disaccharide units. The metabolism of HA is a dynamic process, whith normal turnover in tissues ranging from several weeks to less than a day in skin. HA is synthesized at the plasma membrane by three conserved HA synthases (HAS) and degraded by cell-associated or acid-active hyaluronidases (Culty 1992; Zhou 2000) and exoglycosidase enzymes to monosaccharides following receptor-mediated endocytosis.

HA occurs in the extracellular matrix of many cells, especially in soft connective tissues. Hyaluronan (HA) occurs predominantly in connective tissues, skin, cartilage, and in synovial fluid in mammal. Hyaluronan also is the main constituent of the vitreous of the eye. HA has been assigned various physiological functions, such as in water and plasma protein homeostasis in the intracellular matrix (Laurent T C et al. (1992) FASEB J 6: 2397-2404). In connective tissue, the water of hydration associated with hyaluronan creates spaces between tissues, thus creating an environment conducive to cell movement and proliferation. In the body, for example, in tissues of a subject, hyaluronan (hyaluronic acid) is replaced with a half-life of approximately 5 h, and is largely responsible for the resistance to fluid flow through the tissues. Hyaluronan plays a role in biological phenomena associated with cell motility including rapid development, regeneration, repair, embryogenesis, embryological development, wound healing, angiogenesis, and tumorigenesis (see, e.g., Toole 1991 Cell Biol. Extracell. Matrix, Hay (ed), Plenum Press, New York, 1384-1386; Bertrand et al. 1992 Int. J. Cancer 52:1-6; Knudson et al., 1993 FASEB J. 7:1233-1241). HA production increases in proliferating cells and may play a role in mitosis. It also has been implicated in locomotion and cell migration, as well as roles in cell regulation, development, and differentiation (Laurent et al. (1992) FASEB J 6: 2397-2404).

HA has been used in clinical medicine. Its tissue protective and rheological properties have proved useful in ophthalmic surgery to protect the corneal endothelium during cataract surgery. Serum HA is diagnostic of liver disease and various inflammatory conditions, such as rheumatoid arthritis. Interstitial edema caused by accumulation of HA may cause dysfunction in various organs (Laurent et al. (1992) FASEB J 6: 2397-2404). Hyaluronan protein interactions also are involved in the structure of the extracellular matrix or "ground substance."

HA synthesis is increased when oncogenic viruses transform fibroblasts and elevated levels of HA are associated with hyperproliferative and malignant phenotypes in various cancers, such as melanomas and some carcinomas (see, e.g., Itano et al. (2002) *Proc. Natl. Acad. Sci. U.S.A.* 99; 3609-3614.) In addition, hyaluronan levels correlate with tumor aggressiveness (Ozello et al., 1960 Cancer Res. 20:600-604; Takeuchi et al., 1976, Cancer Res. 36:2133-2139; Kimata et al., 1983 Cancer Res. 43:1347-1354). Local aberrations of HA metabolism have been reported in many solid tumor malignancies, where elevated levels of HA frequently correlate with poor prognosis in tumors such as breast, gastric, colorectal, ovarian, prostate and lung carcinoma. HA accumulation reduces contact inhibition between and among tumor cells ((see, e.g., Itano et al. (2002) Proc. Natl. Acad. Sci. U.S.A. 99; 3609-3614.).

2. Hyaluronan-Associated Diseases

Many diseases or conditions are associated with overexpressed or accumulated expression of hyaluronidase substrate, for example HA, which can exacerbate or contribute to the severity or prognosis of the disease or condition. The underlying cause for HA accumulation is likely due to one or more of HA synthase overexpression, poor lymphatic drainage, or unbalanced synthesis and degradation of the substrate.

Hence, among the hyaluronan-associated diseases, conditions and disorders that can be treated with the provided compositions, compounds and methods are conditions, diseases and disorders that express or accumulate hyaluron as cause, consequence or symptom of the disease, condition or disorder. Such diseases, conditions and/or disorders include, for example, those associated with increased interstitial fluid pressure, decreased vascular volume, increased water content in a tissue, disc pressure and edema. Hyaluronan-associated diseases, conditions and/or disorders, include, but are not limited to, hyaluronan-rich cancers, for example, tumors, including solid tumors, for example, late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and disorders are disc pressure, cancer and edema, for example, edema caused by organ transplant, stroke, brain trauma or other injury.

For example, hyaluronan-associated diseases or conditions include solid tumors, including benign and malignant tumors. Exemplary of solid tumor malignancies include, for example, those associated with breast, gastric, colorectal, ovarian, prostate and lung carcinoma. Aberrant accumulation of HA levels in tumors, in particular malignant tumors, is an indicator of poor prognosis when associated with stromal or cellular compartments.

For example, in a study of survival of patients having breast carcinoma by Auvinen (2000), the five-year survival deteriorated as a function of increasing stromal HA levels; for low, moderate and high HA levels, respectively, the five-year overall survival was 45%, 39%, and 26% ($p=0.002$) and the recurrence-free survival was 66%, 56% and 40% ($p=0.008$). The presence of HA-positive carcinoma cells correlated significantly with axillary lymph node positivity and poor differentiation. The 5-year overall survival of patients exhibiting HA-positive carcinoma cells was significantly lower compared to the patients without HA-positive carcinoma cells (with 54% versus 81%, respectively, $p=0.01$).

In gastric carcinoma, Setala et al. (1999) examined the HA profile of 215 stage I-IV gastric carcinoma patients. A high proportion of HA positive cells were found and were significantly associated with deep tumor invasion, nodal metastasis, positive lymphatic invasion, poor differentiation grade, as well as inferior prognosis in univariate survival analysis. Forty-four percent of the tumors evaluated had a HA labeling index of 30-100% HA positive cells.

In colorectal carcinomas, Ropponen et al. (1998) examined the cellular association of HA to overall survival and recurrence-free survival in 202 colorectal carcinoma samples followed up for a mean of 14 years. Both high HA intensity and labeling indices were frequently found and significantly associated with poorer overall survival, shorter recurrence free survival, and elevated Duke classification for 187 evaluable patients.

Anttila et al. (2000) studied HA levels in 309 epithelial ovarian cancers and 45 matched metastatic lesions. While in 73% (227 of 309) of the cases, the fraction of hyaluronan-positive cancer cells ws<10%, high stromal HA levels were significantly correlated with poor differentiation, serious histologic type, advanced stage, and large primary residual tumor.

Hyaluronan-associated diseases can be treated by administration of a composition containing a hyaluronan degrading enzyme, such as a hyaluronidase, for example, a soluble hyaluronidase, either alone or in combination with or in addition to another treatment and/or agent. Treatment of the hyaluronan-associated condition, disease or disorder includes amelioration, reduction, or other beneficial effect on one or more of any associated physical manifestation or symptom, such as increased interstitial fluid pressure (IFP), decreased vascular volume, and/or increased water content in a tissue.

In one example, treatment of the hyaluronan-associated condition, disease or disorder includes amelioration, reduction, or other beneficial effect on one or more of increased interstitial fluid pressure (IFP), decreased vascular volume, and increased water content in a tissue. In another example, treatment can include amelioration or beneficial effect on another symptom, for example, tumor size (e.g. mass/volume), prognosis, including survival and/or recurrence-free survival of a subject.

3. Methods of Treatment and Compositions

Hence, provided herein are methods and compositions for treating hyaluronan (HA)-associated conditions, diseases and disorders. The methods, such as methods of treatment, use compositions containing a modified hyaluronan degrading enzymes alone or compositions or combinations containing a modified hyaluronan degrading enzyme and further containing one or more additional agents for treating the hyaluronan associated conditions, diseases and/or disorders. In the compositions and combinations employed in the methods herein, the hyaluronan degrading enzymes, such as hyaluronidases, are modified, such as by conjugation to one or more polymer(s), whereby half-life of a hyaluronidase, such as a soluble hyaluronidases, is increased. The modified hyaluronan degrading enzymes provided herein can be used alone to treat hyaluronan associated conditions, diseases and disorders, or can be used in combination with other agents, such as, for example, therapeutic agents (e.g. chemotherapeutic agents). The compositions containing the hyaluronan degrading enzyme and other agent(s) can be provided separately in the combination or provided in a single composition.

In some examples, the modified hyaluronan degrading enzymes are administered alone for treatment of a hyaluronan associated disease or condition. Thus, also provided herein are compositions containing a hyaluronan degrading enzyme, such as a modified soluble hyaluronidase, and methods for administering the modified hyaluronan degrading enzyme for treating a hyaluronan associated disease, i.e. a disease associated with accumulated expression of a hyaluronidase substrate. For example, such treatment can be used for effecting decreased interstitial fluid pressure in a hyaluronan-associated disease, for example, a hyaluronan-rich cancer. As shown herein, treatment with a modified hyaluronan degrading enzyme such as a modified hyaluronidase not only removes hyaluronan and reduces interstitial fluid pressure (IFP), but also, can restore contact inhibition. Thus, administration of a hyaluronan degrading enzyme can effect treatment by virtue of restoration of contact between and among cells. As shown herein, modification of the hyaluronan degrading enzyme, such as by pegylation, improves the effectiveness of the hyaluronan degrading enzyme as a treatment for tumors.

In particular, systemic administration of the modified hyaluronan degrading enzyme is effective for treating tumors, including brain tumors. For example, systemic administration of modified hyaluronan degrading enzyme, such as modified soluble hyaluronidase, decreases interstitial fluid pressure (IFP) in hyaluronan-rich tumors, effecting a dose-dependent and sustained reduction in IFP, for example, reduction that persists greater than 1 hour, 2 hours, 4 hours, 8 hours, 10 hours, 12 hours, 16 hours, 24 hours, 48 hours or 72 hours. The hyaluronidase can effect such a reduction in a hyaluronan-specific manner.

Further, consistent with the ability to reduce hyaluronan expression following administration in a subject with a hyaluronan-associated tumor, systemic administration of the modified hyaluronan degrading enzyme, such as a modified soluble hyaluronidase, can effect sustained reduction in tumor water content, for example, for at least 1 hour, 2 hours, 4 hours, 8 hours, 10 hours, 12 hours, 16 hours 24 hours, 48 hours or 72 hours, and a decrease in vascular volume in hyaluronan-associated tumors, resulting from vascular decompression of blood vessels in the tumor. Thus, further provided herein are compositions containing a modified hyaluronan degrading enzyme, such as a modified soluble hyaluronidase, and methods for administration to effect a sustained increase in vascular volume and/or a sustained increase in water content in a tissue in the subject with a hyaluronan-associated disease or condition, for example, a hyaluronan-associated cancer.

Unmodified hyaluronan-degrading enzymes typically have a short half-life of enzymatic activity in blood of minutes, generally less than 5 minutes. This means that such enzymes are generally unsuitable for use in intravenous administrations, and other administrations, where their duration of action is short-lived. The hyaulronan degrading enzymes, such as soluble hyaluronidases, used in the composition and methods herein are modified by conjugation to a polymer, for example, a sialation moiety or pegylation moiety (PEG). Typically, the polymer increases the half-life of the hyaulronan degrading enzyme, such as hyaluronidase, following administration to the subject. The plasma half-life of enzymatic activity of modified hyaluronan-degrading enzymes (e.g. via conjugation to a polymer) provided herein are generally or are about 1 hour, 2 hours, 3 hour, 4 hours, 5 hours, 6 hours, 7 hours, 8 hours, 10 hours, 11 hours, 12 hours, 13 hours, 14 hours, 15 hours, 20 hours, 25 hours, 30 hours, 35 hours, 40 hours, 45 hours, 50 hours, 55 hours, 60 hours or more. In one example, a soluble hyaluronidase modified by conjugation to a polymer effects more than 100-, 200-, 250-, 300-, 400-, 500-, 600-, 700-, 800-, 900-, 1000-, 1500, 2000-fold or more increase in plasma half-life compared to the unmodified enzyme. In one example, the half-life of the enzyme in plasma is over 24 hours.

Due to the differences in half-life, the duration of activity of a modified hyaluronidase is increased compared to a native (not modified by conjugation to a polymer) hyaluronidase. For example, following administration of native (non-modified) soluble hyaluronidase, for example, hyaluronic acid can be restored within 24 hours, leaving no observable changes. Following administration of a hyaluronan degrading enzyme, such as a hyaluronidase, that has been modified by conjugation to a polymer (e.g. PEG) that increases the half-life of the hyaluronan degrading enzyme, expression of hyaluronan remains reduced at 24 hours, 48 hours, 72 hours, or more following the administration.

Typically, a modified hyaluronan-degrading enzyme conjugated to a polymer has a reduced specific activity compared to the unmodified hyaluronan-degrading enzyme. The specific activity is generally reduced by about or 2-fold, 3-fold, 4-fold, 5-fold or more. For example, as described elsewhere herein, the specific activity of unmodified PH20 designated rHuPH20 is about 120,000 U/mg. The specific activity of a PEGylated rHuPH20 is about 30,000 U/mg. Nevertheless, due to the increased half-life, modified hyaluronan-degrading enzymes exhibit an increased duration of activity. Since HA is able to be regenerated, an enzyme that has a sustained duration of action can counteract HA resynthesis and deposition in the ECM.

Hence, in the methods, combinations and compositions provided herein, a modified hyaluronan-degrading enzyme, for example a soluble hyaluronidase, is provided in an amount sufficient to sustain a minimal plasma level of the HA of at least 3 U/mL of the enzyme in the plasma. For example, the minimal plasma level of HA is maintained at a level that is or is about 3 U/mL-12 U/mL or more, for example, from about or at a level of 4 U/mL, 5 U/mL, 6 U/mL, 7 U/mL, 8 U/mL, 9 U/mL, 10 U/mL, 11 U/mL, 12 U/mL, 13 U/mL, 14 U/mL, 15 U/mL, 16 U/mL, 17 U/mL, 18 U/mL, 19 U/mL, 20 U/mL, 25 U/mL, 30 U/mL, 35 U/mL, 40 U/mL, 45 U/mL, 50 U/mL or more. By maintaining at least 3 U/mL of the enzyme in the plasma, the enzyme can remove HA associated with a disease or condition, for example, tumoral HA, and also counteract HA resynthesis. Thus, in such treatments, the hyaluronidase substrate is not allowed to accumulate. For diseases or conditions, such as cancers having malignant solid tumors, whose prognosis is associated with HA expression, the condition (e.g. cancerous condition) can be treated and/or ameliorated.

Hence, the provided compositions containing hyaluronan degrading enzymes, such as soluble hyaluronidases, conjugated to polymers can provide prolonged or sustained treatment of diseases or conditions associated with accumulated hyaluronidase substrate, for example, prolonged or sustained amelioration of one or more symptoms. For example, systemic (e.g. intravenous) administration of a modified soluble hyaluronidase, which is modified by conjugation with a polymer, can effect a sustained (e.g. at least 24, 48, and 72 hours) reduction in hyaluronan expression in per cellular matrices in a tissue of hyaluronan-rich tumors.

In order to sustain effect of the modified enzyme in plasma for longer periods of times, cycles of administration can be effected. Hence, the modified enzymes can be administered successively over a dosing regime in order to maintain a constant level of the modified hyaluronidase in the plasma for any desired length of time. The level in the plasma can be monitored during the course of treatment as described herein by measuring the level of the modified hyaluronidase in the plasma. This means that over the course of treatment a minimal level of the hyaluronidase is present in plasma sufficient not only to remove HA associated with a disease or condition, but also to counteract HA resynthesis. Successive administrations can be made periodically whenever the level in the plasma falls below at least or about 3 U/mL. It, however, is not necessary to measure the plasma level before each administration. Generally, to maintain levels in plasma of the hyaluronidase of at least 3 U/mL, compositions containing hyaluronan-degrading enzymes, such as soluble hyaluronidases, conjugated to polymers are administered several times a month, generally at least once a week and typically more than once a week. For example, the modified hyaluronan degrading enzymes, for example, modified soluble hyaluronidase, are administered twice a week, three times a week, four times a week, five times a week, six times a week or daily. Typically, such enzymes are administered twice a week.

As discussed elsewhere herein, the dose of modified hyaluronidase enzyme necessary to maintain a plasma level of the hyaluronidase of at least 3 U/mL can be empirically determined. Generally, as exemplified herein, the dose of a single administration of a modified soluble hyaluronidase to maintain at least 3 U/mL in the plasma over a cycle of administration is or is about 0.02 mg/kg (of the subject), 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg or more. Typically, the dose is or is about 0.05 mg/kg to at or about 0.8 mg/kg. As discussed below, it is understood that such amounts are administered periodically (e.g. twice weekly) over a cycle of administration to maintain the plasma level for a desired length of time. Assuming that the average human is 75 kg, a modified soluble hyaluronidase that has a specific activity of at or about 20,000 U/mg to 60,000 U/mg, generally at or about 35,000 U/mg, is administered at or about 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more. For example, compositions of a modified hyaluronidase can be administered that contain at or about 2.0-60 mg of a modified hyaluronidase. Also provided herein are such compositions.

The length of time of the cycle of administration can be empirically determined, and is dependent on the disease to be treated, the severity of the disease, the particular patient, and other considerations within the level of skill of the treating physician. The length of time of treatment with a modified hyaluronidase enzyme can be one week, two weeks, one months, several months, one year, several years or more. For example, a modified hyaluronidase enzyme can be administered twice weekly over a period of a year or more. If disease symptoms persist in the absence of discontinued treatment, treatment can be continued for an additional length of time. Over the course of treatment, evidence of disease and/or treatment-related toxicity or side effects can be monitored.

In addition, the cycle of administration can be tailored to add periods of discontinued treatment in order to provide a rest period from exposure to the enzyme. The length of time for the discontinuation of treatment can be for a predetermined time or can be empirically determined depending on how the patient is responding or depending on observed side effects. For example, the treatment can be discontinued for one week, two weeks, one month or several months. It is understood and expected that during the period of discontinued treatment, the plasma level of the hyaluronidase will fall below 3 U/mL. Generally, the period of discontinued treatment is built into a cycle of dosing regime for a patient. For example, an exemplary dosing regime is a treatment cycle of 28 days, with the modified enzyme administered for the first 3 weeks, twice weekly, followed by a one week without dosing. In one example, 0.05 mg/kg-0.8 mg/kg of modified enzyme can be administered twice weekly for 3 weeks, followed by a one week without dosing. Thus, for example, a patient can be dosed with modified enzyme on days 1, 4, 8, 11, and 18, followed by a one-week of discontinued treat, over the course of the 28-day cycle. As noted above, the cycle of administration can be for any desired length of time. Hence, the 28-day cycle of administration can be repeated for any length of time. It is within the level of skill of the treating physician to adopt a cycle of administration and dosing regime that meets the needs of the patient depending on personal considerations specific to the patient and disease to be treated.

4. Combinations and Methods of Treatment Thereof

Hyaluronan degrading enzymes such as hyaluronidase temporarily digest the hyaluronic acid, thereby facilitating delivery of agents. Thus, for example, due to the ability of hyaluronan degrading enzymes to open channels in the interstitial space through degradation of glycosaminoglycans, administration of a hyaluronan degrading enzyme, such as a soluble hyaluronidase, permits the diffusion of molecules, thereby improving the bioavailability, pharmacokinetics and/or pharmacodynamic characteristics of co-formulated or co-administered molecules, or molecules administered after administration of the hyaluronidase. In some examples, the bioavailability of the molecules with hyaluronidase is 70%, 80%, 90%, 91%, 92%, 93%, 94%, 95%, 96%, 97%, 98%, 99%, or 100% of the bioavailability of the molecule without hyaluronidase administration. Typically, the bioavailability is greater than 90%. In addition, as discussed above, hyaluronan degrading enzymes, including modified hyaluronan degrading enzymes, can treat tumors by virtue of other mechanisms.

Thus, in one example, treatment of the hyaluronan-associated condition, disease or disorder includes administration of a composition containing a modified hyaluronan degrading enzyme, such a modified soluble hyaluronidase, and one or more additional agents and/or treatment for treating the disease or disorder, for example, an anti-cancer agent, such as a chemotherapy, antibody, vector or nucleic acid for treating cancer. In this example, the second treatment or agent can be administered separately or together with the hyaluronidase. For example, the modified hyaluronan degrading enzymes are administered before, after or with an additional agent or treatment. Hence, hyaluronan degrading enzymes, particularly modified hyaluronan degrading enzymes, such as pegylated soluble hyaluronidases, can be administrated as therapeutic agents alone or in combination with other therapeutic agents. Hyaluronan degrading enzyme, such as hyaluronidase, administration can facilitate therapeutic agent delivery, for example, via intravenous, subcutaneous and/or intra-tumoral delivery, particularly for delivery of treatments or agents to tissues having a high expression of extracellular hyaluronan, for example, tissues that exhibit HALO (pericellular matrix regions that are rich in proteoglycans, including hyaluronan) formation. By virtue of the ability of the hyaluronan degrading enzyme, such as a hyaluronidase, to break down hyaluronan in the extracellular matrix, hyaluronan degrading enzymes facilitate administration of therapeutic agents to the desired location.

Typically, the second agent and the modified hyaluronan degrading enzyme, for example, a modified hyaluronidase enzyme, are administered separately. For example, the additional agent or treatment can be administered simultaneously, sequentially or intermittently in any order. Typically, the modified hyaluronan degrading enzyme, such as a hyaluronidase, is administered prior to the additional agent and/or treatment, for example, at least 0.5, 1, 5, 15, or 30 minutes, or 1, 2, 3, 4, 5, 6, 7, 8, 10, 12, 14, 16, 18, 20, 22, 24, 36, 48, 72 or more hours prior to the additional agent or treatment. In some examples, due to the long-half life of a modified enzyme and its duration of action, a modified enzyme can be administered at least 24 or about 24 hours, at least 48 or about 48 hours, or at least 72 or about 72 hours or more, prior to the administration of the additional agent or treatment.

The frequency of administration of the second agent can be empirically determined. The determination of frequency of administration is within the level of a skilled physician and is dependent on a number of factors including the particular disease or condition being treated, the severity of disease, the patient to be treated, and the cycle of administration of the modified enzyme. Generally, the timing of administration of the second agent, for example an anti-cancer agent or treatment (e.g. chemotherapeutic), is typically a function of the cycle of administration of the modified enzyme. For example, the second agent can be adminstered after the first administration of the modified enzyme in a cycle of administration, and/or after any one or more subsequent administrations in the cycle. In other examples, the second agent is administered after each subsequent administration of the modified enzyme in the cycle, after every other subsequent administration of the modified enzyme in the cycle, or is administered once a week, once every two weeks, once every three weekes, or once a month during the cycle of administration of the modified enzyme. In some examples, the second agent is only administered once per cycle of administration of the modified enzyme. In additional example, the second agent is administered intermittently between cycles of administration. For example, the second agent is not administered during the first cycle of administration, but is administered during a second cycle, followed by skipping the third cycle and administered again during a fourth cycle, etc. . . . or any variation thereof.

The following sections describe exemplary compositions and compounds containing modified hyaluronan degrading enzymes, such as modified soluble hyaluronidases and/or other agents, methods of making them, and using them to treat hyaluronan-associated diseases, disorders and conditions.

C. COMPOSITIONS CONTAINING HYALURONAN DEGRADING ENZYMES

Provided herein are compositions containing modified hyaluronan degrading enzymes, in particular soluble hyaluronidases, and methods of using such compositions for administration for the treatment of hyaluronan-associated diseases and conditions. The hyaluronan degrading enzymes contained in the compositions provided herein are modified by conjugation to a polymer (e.g. PEG). Any such modified hyaluronan degrading enzyme can be used herein provided the enzyme exhibits enzymatic activity for hyaluronic acid (e.g. hyaluronidase activity). In some instances, the modified hyaluronan degrading enzymes used in the methods, compositions and combinations herein exhibit increased hyaluronidase activity compared to the unmodified hyaluronan degrading enzyme (e.g. not conjugated to a polymer). Generally, as discussed elsewhere herein, a modified hyaluronan-degrading enzyme exhibits increased half-life compared to an unmodified hyaluronan-degrading enzyme.

Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, hyaluronan degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-1→4 and $\beta$-1→3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the $\beta$-1→4 glycosidic bond in the hyaluronan chain or polymer. In other examples, the hyaluronan degrading enzyme catalyze the cleavage of the $\beta$-1→6 glycosidic bond in the hyaluronan chain or polymer.

Hence, hyaluronan degrading enzymes, such as hyaluronidases, are a family of enzymes that degrade hyaluronic acid, which is an essential component of the extracellular matrix and a major constituent of the interstitial barrier. By catalyzing the hydrolysis of hyaluronic acid, a major constituent of the interstitial barrier, hyaluronan degrading enzymes lower the viscosity of hyaluronic acid, thereby increasing tissue permeability. As such, hyaluronan degrading enzymes, such as hyaluronidases, have been used, for example, as a spreading or dispersing agent in conjunction with other agents, drugs and proteins to enhance their dispersion and delivery. Hyaluronan-degrading enzymes also are used as an adjuvant to increase the absorption and dispersion of other injected drugs, for hypodermoclysis (subcutaneous fluid administration), and as an adjunct in subcutaneous urography for improving resorption of radiopaque agents. Hyaluronan-degrading enzymes, for example, hyaluronidase can be used in applications of ophthalmic procedures, for example, peribulbar and sub-Tenon's block in local anesthesia prior to ophthalmic surgery. Hyaluronidase also can be use in other therapeutic and cosmetic uses, for example, by promoting akinesia in cosmetic surgery, such as blepharoplasties and face lifts.

Various forms of hyaluronan degrading enzymes, including hyaluronidases have been prepared and approved for therapeutic use in subjects, including humans. The provided compositions and methods can be used, via these and other therapeutic uses, to treat hyaluronan-associated diseases and conditions. For example, animal-derived hyaluronidase preparations include Vitrase® (ISTA Pharmaceuticals), a purified ovine testicular hyaluronidase, and Amphadase® (Amphastar Pharmaceuticals), a bovine testicular hyaluronidase. Hylenex® (Halozyme Therapeutics) is a human recombinant hyaluronidase produced by genetically engineered Chinese Hamster Ovary (CHO) cells containing nucleic acid encoding for soluble rHuPH20.

Exemplary of hyaluronan degrading enzymes in the compositions and methods provided herein are soluble hyaluronidases. Other exemplary hyaluronan degrading enzymes include, but are not limited to particular chondroitinases and lyases that have the ability to cleave hyaluronan.

As described below, hyaluronan-degrading enzymes exist in membrane-bound or soluble form. For purposes herein, soluble hyaluronan-degrading enzymes are provided for use in the methods, uses, compositions or combinations herein. Thus, where hyaluronan-degrading enzymes include a glycosylphosphatidylinositol (GPI) anchor and/or are otherwise membrane-anchored or insoluble, hyaluronan-degrading enzymes are provided herein in soluble form. Thus, hyaluronan-degrading enzymes include truncated variants, e.g. truncated to remove all or a portion of a GPI anchor. Hyaluronan-degrading enzymes provide herein also include allelic or species variants or other variants, of a soluble hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

Where the methods and uses provided herein describe the use of a soluble hyaluronidase, accordingly any hyaluronan degrading enzyme, generally a soluble hyaluronan degrading enzyme, can be used.

1. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, combinations and methods provided.

a. Mammalian-Type Hyaluronidases

Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721)), sheep (*ovis aries*) (SEQ ID NO: 26, 27, 63 and 65), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), cynomolgus monkey (SEQ ID NO:29), guinea pig (SEQ ID NO:30), and human hyaluronidases. Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NO:27), bovine (SEQ ID NO:11) and human (SEQ ID NO:1). Human PH20 (also known as SPAM1 or sperm surface protein PH20), is generally attached to the plasma membrane via a glycosylphosphatidylinositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidylinositol (GPI) anchor such as human HYAL2 and human PH20 (Danilkovitch-Miagkova, et al. (2003) Proc Natl Acad Sci USA 100(8): 4580-5), and those which are generally soluble such as human HYAL1 (Frost et al. (1997) *Biochem Biophys Res Commun.* 236(1):10-5).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. They have both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), chimpanzee (SEQ ID NO:101), Rhesus monkey (SEQ ID NO:102) bovine (SEQ ID NOS: 11 and 64), rabbit (SEQ ID NO: 25), ovine PH20 (SEQ ID NOS: 27, 63 and 65), Cynomolgus monkey (SEQ ID NO: 29), guinea pig (SEQ ID NO: 30), rat (SEQ ID NO: 31) and mouse (SEQ ID NO: 32) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G I (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 is, therefore, a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at both neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at both neutral and acid pH. It appears that PH20 contains two catalytic sites at distinct regions of the polypeptide: the Peptide 1 and Peptide 3 regions (Cherr et al., (2001) Matrix Biology 20:515-525). Evidence suggests that the Peptide 1 region of PH20, which corresponds to amino acid positions 107-137 of the mature polypeptide set forth in SEQ ID NO:2 and positions 142-172 of the precursor polypeptide set forth in SEQ ID NO: 1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) Eur. J. Biochem. 247:810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) Eur. J. Biochem. 247:810-814).

In addition to the catalytic sites, PH20 also contains a hyaluronan-binding site. Experimental evidence suggest that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) Eur. J. Biochem. 247:810-814).

There are seven potential N-linked glycosylation sites in human PH20 at N82, N166, N235, N254, N368, N393, N490 of the polypeptide exemplified in SEQ ID NO: 1. Because amino acids 36 to 464 of SEQ ID NO:1 appears to contain the minimally active human PH20 hyaluronidase domain, the N-linked glycosylation site N-490 is not required for proper hyaluronidase activity. There are six disulfide bonds in human PH20. Two disulphide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulphide bonds are formed between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

b. Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides,* and *Streptomyces.* Particular examples of such enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* (SEQ ID NO:70); 18RS21 (SEQ ID NO:71); serotype Ia (SEQ ID NO:72); serotype III (SEQ ID NO:73), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES 114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

c. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*,), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol. Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

2. Other Hyaluronan Degrading Enzymes

In addition to the hyaluronidase family, other hyaluronan degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272:9123-9130). A exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 98 (Sato et al. (1994) *Appl. Microbiol. Biotechnol.* 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. I Biochem.* 262:127-133)

3. Soluble Hyaluronan Degrading Enzymes

Provided in the compositions, combinations, uses and methods herein are modified soluble hyaluronan degrading enzymes, including modified soluble hyaluronidases. Soluble hyaluronan degrading enzymes include any hyaluronan degrading enzymes that exist in soluble form, including, but not limited to, soluble hyaluronidases, including non-human soluble hyaluronidases, including non-human animal soluble hyaluronidases, bacterial soluble hyaluronidases and human hyaluronidases, Hyal 1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of a soluble hyaluronidase is PH20 from any species, such as any set forth in any of SEQ ID NOS: 1, 2, 11, 25, 27, 30, 31, 63-65 and 101-102, or truncated forms thereof lacking all or a portion of the C-terminal GPI anchor, so long as the hyaluronidase is soluble and retains hyaluronidase activity. Also included among soluble hyaluronidases are allelic variants or other variants of any of SEQ ID NOS:1, 2, 11, 25, 27, 30 31, 63-65 and 101-102, or truncated forms thereof. Allelic variants and other variants are known to one of skill in the art, and include polypeptides having 60%, 70%, 80%, 90%, 91%, 92%, 93%, 94%, 95%. 96%. 97%. 98% or more sequence identity to any of SEQ ID NOS: 1, 2, 11, 25, 27, 30 31, 63-65 and 101-102, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and co-site, and performing solubility analyses before and after digestion with phosphatidylinositol-specific phospholipase C(PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence. Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS:1, 2 or 101, or allelic or other variation thereof, including active fragment thereof, wherein the resulting polypeptide is soluble and retains one or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 1 or 2. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2 or 101, provided the resulting esPH20 polypeptide is soluble and retains 1 or more amino acid residues from the GPI-anchor attachment signal sequence.

Typically, for use in the compositions, combinations and methods herein, a soluble human hyaluronan degrading enzyme, such as a soluble human PH20, is used. Although hylauronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

a. Soluble Human PH20

Exemplary of a soluble hyaluronidase is soluble human PH20, Soluble forms of recombinant human PH20 have been produced and can be used in the compositions, combinations and methods described herein. The production of such soluble forms of PH20 is described in U.S. Published Patent Application Nos. US20040268425; US 20050260186 and US20060104968, and in the Examples, below. For example, soluble PH20 polypeptides, include C-terminally truncated variant polypeptides that include a sequence of amino acids in SEQ ID NO:1, or have at least 91%, 92%, 93%, 94%, 95%, 95%, 97%, 98% sequence identity to a sequence of amino acids included in SEQ ID NO:1, retain hyaluronidase activity and are soluble. Included among these polypeptides are soluble PH20 polypeptides that completely lack all or a portion of the GPI-anchor attachment signal sequence. Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 5, 60 or more amino acids compared to the full length wild type polypeptide, such as a full length wild type polypeptide with a sequence set forth in SEQ ID NOS:1 or 2, or allelic or species variants or other variants thereof.

Exemplary C-terminally truncated human PH20 polypeptides provided herein include any having C-terminal truncations to generate polypeptides containing amino acid 1 to amino acid 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, of the sequence of amino acids set forth in SEQ ID NO: 1, or corresponding positions in an allelic or species variant thereof. When expressed in mammalian cells, the 35 amino acid N-terminal signal sequence is cleaved during processing, and the mature form of the protein is secreted. Thus, exemplary mature C-terminally truncated soluble PH20 polypeptides can contain amino acids 36 to 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497 of the sequence of amino acids set forth in SEQ ID NO: 1 or corresponding positions in an allelic or species variant thereof. Table 2 provides non-limiting examples of exemplary C-terminally truncated PH20 polypeptides, including C-terminally truncated soluble PH20 polypeptides. In Table 2 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 2 for comparison.

TABLE 2

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-PSTL | 489 | 111 | 454 | 155 |
| SPAM1-SPST | 488 | 144 | 453 | 188 |
| SPAM1-STLS | 490 | 112 | 455 | 156 |
| SPAM1-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

Soluble forms include, but are not limited to, any having C-terminal truncations to generate polypeptides containing amino acids 1 to amino acid 467, 477, 478, 479, 480, 481, 482 and 483 of the sequence of amino acids set forth in SEQ ID NO:1. When expressed in mammalian cells, the 35 amino acid N-terminal signal sequence is cleaved during processing, and the mature form of the protein is secreted. Thus, the mature soluble polypeptides contain amino acids 36 to 467, 477, 478, 479, 480, 481, 482 and 483 of SEQ ID NO:1. Deletion mutants ending at amino acid position 477 to 483 (corresponding to the precursor polypeptide set forth in SEQ ID NO:1) exhibit higher secreted hyaluronidase activity than the full length GPI-anchored form. Hence, exemplary of soluble hyaluronidases soluble human PH20 polypeptides that are 442, 443, 444, 445, 446 or 447 amino acids in length, such as set forth in any of SEQ ID NOS: 4-9, or allelic or species variants or other variants thereof.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

b. rHuPH20

Recombinant soluble forms of human PH20 have been generated and can be used in the compositions, combinations and methods provided herein. The generation of such soluble forms of recombinant human PH20 are described in U.S. Published Patent Application Nos. US20040268425; US 20050260186 and US20060104968, and in Examples 2-6, below. Exemplary of such polypeptides are those generated from a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS. 4-9 in various abundance. Typically, rHuPH20 is produced in cells that facilitate correct N-glycosylation to retain activity, such as CHO cells (e.g. DG44 CHO cells).

4. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc-cores attached via the amide nitrogen of Asn residues that fall within-Asn-Xaa-Thr/Ser-sequences (where Xaa is not Pro). Glycosylation at an-Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides.

There are seven potential N-linked glycosylation sites at N82, N166, N235, N254, N368, N393, N490 of human PH20 exemplified in SEQ ID NO: 1. As noted above, N-linked glycosylation at N490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyaluronidases include soluble forms of a partially deglycosylated PH20 polypeptides from any species, such as any set forth in any of SEQ ID NOS: 1, 2, 11, 25, 27, 29, 30, 31, 32, 63, 65, 101 and 102, or allelic variants, truncated variants, or other variants thereof. Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29, 30, 31, 32, 63, 65, 101 and 102, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. Typically, the partially deglycosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

5. Modified (Polymer-Conjugated) Hyaluronan Degrading Enzymes

In one example, the provided compositions and combinations contain hyaluronan degrading enzymes, in particular soluble hyaluronidases, that have been modified by conjugation to one or more polymeric molecule (polymer), typically to increase the half-life of the hyaluronan degrading enzyme, for example, to promote prolonged/sustained treatment effects in a subject.

Covalent or other stable attachment (conjugation) of polymeric molecules, such as polyethylene glycol (pegylation moiety (PEG)), to the hyaluronan degrading enzymes, such as hyaluronidases, impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, such as the hyaluronidase, include natural and synthetic homopolymers, such as polyols (i.e. poly-OH), polyamines (i.e. poly-$NH_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polypropylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran and pullulan, have few reactive groups capable of cross-linking. Typically, the polymers are non-toxic polymeric molecules such as (m)polyethylene glycol (mPEG) which can be covalently conjugated to the hyaluronan degrading enzyme, such as the hyaluronidase (e.g. to attachment groups on the protein's surface) using a relatively simple chemistry.

Pegylation of therapeutics has been reported to increase resistance to proteolysis, increase plasma half-life, and decrease antigenicity and immunogenicity. Examples of pegylation methodologies are known in the art (see for example, Lu and Felix, Int. J. Peptide Protein Res., 43: 127-138, 1994; Lu and Felix, Peptide Res., 6: 142-6, 1993; Felix et al., Int. J. Peptide Res., 46: 253-64, 1995; Benhar et al., J. Biol. Chem., 269: 13398-404, 1994; Brumeanu et al., J Immunol., 154: 3088-95, 1995; see also, Caliceti et al. (2003) Adv. Drug Deliv. Rev. 55(10):1261-77 and Molineux (2003) Pharmacotherapy 23 (8 Pt 2):3S-8S). Pegylation also can be used in the delivery of nucleic acid molecules in vivo. For example, pegylation of adenovirus can increase stability and gene transfer (see, e.g., Cheng et al. (2003) Pharm. Res. 20(9): 1444-51).

Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., Advanced Drug Delivery Review 2002, 54: 459-476; Harris and Zalipsky, S (eds.) "Poly(ethylene glycol), Chemistry and Biological Applications" ACS Symposium Series 680, 1997; Mehvar et al., J. Pharm. Pharmaceut. Sci., 3(1):125-136, 2000; Harris, Nature Reviews 2:215 et seq. (2003); and Tsubery, J. Biol. Chem. 279(37):38118-24, 2004). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

a. PEGylated Soluble Hyaluronan Degrading Enzymes

The hyaluronan degrading enzyme used in the methods, compositions and combinations herein can be a PEGylated hyaluronan degrading enzyme, such as a PEGylated soluble hyaluronan degrading enzyme. In one example, it is a PEGylated soluble hyaluronidase, e.g. PEGylated rHuPH20. Various methods of modifying polypeptides by covalently attaching (conjugating) a PEG or PEG derivative (i.e. "PEGylation") are known in the art (see e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see e.g., Harris, Adv. Drug Deliv. Rev. 54:459-476, 2002), attachment of multiple PEG moieties to a single conjugation site (such as via use of branched PEGs; see e.g., Veronese et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. Nos. 5,672,662; 5,932,462; 6,495,659; 6,737,505; 4,002,531; 4,179,337; 5,122,614; 5,183,550; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/000360; U.S. 2005/0114037; U.S. 2005/0171328; U.S. 2005/0209416; EP 01064951; EP 0822199; WO 00176640; WO 0002017; WO 0249673; WO 9428024; and WO 0187925).

D. METHODS OF PRODUCING NUCLEIC ACIDS ENCODING A HYALURONAN DEGRADING ENZYME AND POLYPEPTIDES THEREOF

Polypeptides of a hyaluronan degrading enzyme, such as a soluble hyaluronidase, set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant soluble hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (INVITROGEN, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T71ac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Hyaluronan degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan degrading enzyme polypeptides, such as soluble hyaluronidase polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including hyaluronan degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR)

and thymidine kinase. For example, expression can be performed in the presence of methotrexate to select for only those cells expressing the DHFR gene. Fusion with cell surface signaling molecules such as TCR-ζ and $Fc_\epsilon RI$-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., cat #11619-012) and the serum free EBNA-1 cell line (Pham et al., (2003) *Biotechnol. Bioeng.* 84:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Method for purification of polypeptides, including hyaluronan degrading enzyme polypeptides (e.g. soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble hyaluronidase polypeptides, can be purified using standard protein purification techniques known in the art including but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis and staining and spectrophotometric techniques. Purified rHuPH20 compositions, as provided herein, typically has a specific activity of about 120,000 Units/mg, as determined in Example 2.

4. PEGylation of Hyaluronan Degrading Enzyme Polypeptides

Polyethylene glycol (PEG) has been widely used in biomaterials, biotechnology and medicine primarily because PEG is a biocompatible, nontoxic, nonimmunogenic and water-soluble polymer (Zhao and Harris, ACS Symposium Series 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., Macromolecules 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., Eur. Polym J. 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG, succinimidyl mPEG, $mPEG_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched $mPEG_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. Nos. 5,672,662; 5,932,462; 6,495,659; 6,737,505; 4,002, 531; 4,179,337; 5,122,614; 5,183,550; 5,324,844; 5,446, 090; 5,612,460; 5,643,575; 5,766,581; 5,795,569; 5,808, 096; 5,900,461; 5,919,455; 5,985,263; 5,990,237; 6,113, 906; 6,214,966; 6,258,351; 6,340,742; 6,413,507; 6,420, 339; 6,437,025; 6,448,369; 6,461,802; 6,828,401; 6,858, 736; U.S. 2001/0021763; U.S. 2001/0044526; U.S. 2001/ 0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/ 0013637; US 2004/0235734; U.S. 2005/000360; U.S. 2005/ 0114037; U.S. 2005/0171328; U.S. 2005/0209416; EP 01064951; EP 0822199; WO 00176640; WO 0002017; WO 0249673; WO 9428024; and WO 0187925).

In one example, the polyethylene glycol has a molecular weight ranging from about 3 kD to about 50 kD, and preferably from about 5 kD to about 30 kD. Covalent attachment of the PEG to the drug (known as "PEGylation") may be accomplished by known chemical synthesis techniques. For example, the PEGylation of protein may be accomplished by reacting NHS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatized PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan degrading enzyme and reduced in the presence of NaCNBH$_3$. More specifically, PEGylated CMP sugars can be reacted with a hyaluronan degrading enzyme in the presence of appropriate glycosyl-transferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially may cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated hyaluronan degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Harris, Adv. Drug Deliv. Rev. 54:459-476, 2002), attachment of multiple PEG moieties to a single conjugation site (such as via use of branched PEGs; see e.g., Veronese et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

As an exemplary illustration of the pegylation of an illustrative method for making PEGylated hyaluronan degrading enzymes, such as PEGylated hyaluronidases, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These pegylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) comprising either linear or branched PEGs can be conjugated to rHuPH20. PEGs can used to generate rHuPH20s reproducibly comprising a combination of molecules having between about three to six PEG molecules per hyaluronidase. Such pegylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

Using various PEG reagents, exemplary versions of hyaluronan degrading enzymes, in particular soluble human recombinant hyaluronidases (e.g. rHuPH20), can be prepared, for example, using mPEG-SBA (30 kD), mPEG-SMB (30 kD), and branched versions based on mPEG2-NHS (40 kD), mPEG2-NHS (60 kD). PEGylated versions of rHuPH20 have been generated using NHS chemistries, as well as carbonates, and aldehydes, using each of the following reagents: mPEG2-NHS-40K branched, mPEG-NHS-10K branched, mPEG-NHS-20K branched, mPEG-NHS-40K branched, mPEG2-NHS-60K branched; mPEG-SBA-5K; mPEG-SBA-20K; mPEG-SBA-30K; mPEG-SMB-20K; mPEG-SMB-30K; mPEG-butyraldehyde-; mPEG-SPA-20K; mPEG-SPA-30K; and PEG-NHS-5K-biotin. PEGylated hyaluronidases have also been prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 Kda) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG, as shown in Scheme 1, below.

Scheme 1:

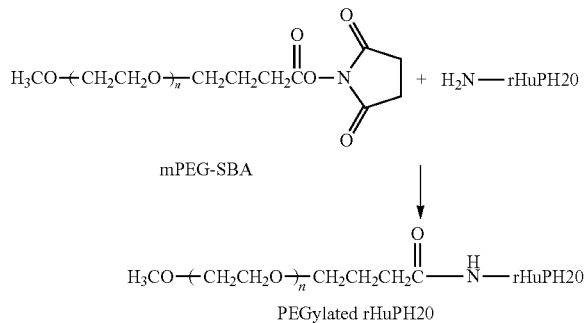

mPEG-SBA

PEGylated rHuPH20

Typically, the mPEG-SBA-30K or other PEG is added to the hyaluronan degrading enzyme, in some instances a hyaluronidase, at a PEG:polypeptide molar ratio of 10:1 in a suitable buffer, e.g. 130 mM NaCl/10 mM HEPES at pH 6.8, followed by sterilization, e.g. sterile filtration, and continued conjugation, for example, with stirring, overnight at 4° C. in a cold room. In one example, the conjugated PEG-hyaluronan degrading enzyme is concentrated and buffer-exchanged.

Other methods of coupling succinimidyl esters of PEG butanoic acid derivatives, such as mPEG-SBA-30K are known in the art (see e.g., U.S. Pat. Nos. 5,672,662; 6,737,505; and U.S. 2004/0235734). For example, a polypeptide, such as a hyaluronan degrading enzyme (e.g. a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

F. PREPARATION, FORMULATION AND ADMINISTRATION OF COMPOSITIONS

Pharmaceutical compositions of modified hyaluronan degrading enzyme, such as modified soluble hyaluronidases, conjugated to a polymer are provided herein. Also provided are pharmaceutical compositions containing a second agent that is used to treat a disease or disorder associated with a hyaluronan-associated disease or condition. Exemplary of such agents include, but are not limited to, anti-cancer agents including drugs, polypeptides, nucleic acids, antibodies, peptides, small molecules, gene therapy vector, viruses and other therapeutics. Modified hyaluronan degrading enzymes, including modified soluble hyaluronidases, can be co-formulated or co-administered with pharmaceutical formulations of such second agents to enhance their delivery to desired sites or tissues within the body associated with excess or accumulated hyaluronan. For example, tumors are associated with accumulated hyaluronan. Such excess hyaluronan can contribute to impeding hydraulic conductivity. The introduction of hyaluronan degrading enzymes such as soluble hyaluronidases, in particular soluble hyaluronidases conjugated to a polymer to increase half-life, can counteract the accumulation of hyaluronan in such tissues, thereby improving hydraulic conductivity within the site or tissue, rendering the site or tissue more susceptible to delivery of a second agent or agents either by local or systemic delivery. For example, provided herein is a composition of a pegylated soluble hyaluronidase, such as rHuPH20, that, when administered together or separately (intermittently, simultaneously or sequentially) with a composition containing an anti-cancer agent to a tumor, can render the tumor more susceptible to such anti-tumor agents. As discussed elsewhere herein, a composition of a pegylated soluble hyaluronidase also can be administered alone to treat diseases or conditions associated with accumulated hyaluronidase substrate expressions.

The compounds can be formulated into suitable pharmaceutical preparations such as solutions, suspensions, tablets, dispersible tablets, pills, capsules, powders, sustained release formulations or elixirs, for oral administrate, as well as transdermal patch preparation and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126). Generally, the mode of formulation is a function of the route of administration. The compositions can be co-formulated or provided as separate compositions.

Generally, the compositions are formulated in lyophilized or liquid form. Where the compositions are provided in lyophilized form they can be reconstituted just prior to use by an appropriate buffer, for example, a sterile saline solution. The compositions can be provided together or separately. For purposes herein, such compositions typically are provided separately. The hyaluronan degrading enzyme, such as soluble hyaluronidase, and second agent can be packaged as separate compositions for administration together, sequentially or intermittently. The combinations can be packaged as a kit.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease the particular composition which is used. For purposes herein, it is desired that a hyaluronan degrading enzyme, such as a soluble hyaluronidase, and/or second agent are administered such that a pharmaceutically available amount or level exists in the plasma). For example, compositions are administered sytemically, for example, via intravenous administration. In some cases, such compositions are administered such that they reach interstitium of skin or tissues having accumulated hyaluronan. For example, the introduction of soluble hyaluronidases to tumor interstitial would enhance the delivery of locally delivered as well as systemically available anti-cancer agents which can more readily penetrate the tumor when interstitial fluid pressure is reduced and diffusion and/or connective transport increased. Hence, a hyaluronan degrading enzyme, such as a soluble hyaluronidase, and the second agent or agents can be administered by different routes of administration. Thus, in one example, a soluble hyaluronidase is administered locally, for example, intratumorally, to the site or tissue associated with accumulated hyaluronan, and the second agent is administered systemically, for example, by intravenous administration. Other modes of administration also are contemplated. Pharmaceutical compositions can be formulated in dosage forms appropriate for each route of administration.

Administration methods can be employed to decrease the exposure of hyaluronan degrading enzymes, e.g. soluble hyaluronidases, and other molecules to degradative processes, such as proteolytic degradation and immunological intervention via antigenic and immunogenic responses. Examples of such methods include local administration at the site of treatment.

1. Formulations

Pharmaceutically acceptable compositions are prepared in view of approvals for a regulatory agency or other agency prepared in accordance with generally recognized pharmacopeia for use in animals and in humans. Compositions can take the form of solutions, suspensions, emulsion, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. The formulation should suit the mode of administration.

Pharmaceutical compositions can include carriers such as a diluent, adjuvant, excipient, or vehicle with which an enzyme or activator is administered. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acaciagelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents.

In one example, pharmaceutical preparation can be in liquid form, for example, solutions, syrups or suspensions. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutically therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, sterile parenteral solutions or suspensions, and oral solutions or suspensions, and oil water emulsions containing suitable quantities of the compounds or pharmaceutically acceptable derivatives thereof. Unit dose forms can be contained ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Pharmaceutical composition can be formulated in dosage forms appropriate for each route of administration.

a. Injectables, Solutions and Emulsions

Parenteral administration, generally characterized by injection, either subcutaneously, intramuscularly, intratumorally, intravenously or intradermally is contemplated herein. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. In addition, if desired, the pharmaceutical compositions to be administered may also contain an activator in the form of a solvent such as pH buffering agents, metal ion salts, or other such buffers. The pharmaceutical compositions also may contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

For example, a standard stabilized formulation of a modified soluble hyaluronidase as provided herein is formulated with one or more of EDTA, NaCl, $CaCl_2$, histidine, lactose, albumin, Pluronic® F68, TWEEN® and/or other detergent or other similar agents. For example, compositions provided herein can contain one or more pH buffers (such as, for example, histidine, phosphate, or other buffers), or acidic buffer (such as acetate, citrate, pyruvate, Gly-HCl, succinate, lactate, maleate or other buffers), tonicity modifier (such as, for example, an amino acid, polyalcohol, NaCl, trehalose, other salts and/or sugars), stabilizer, chelating agent, such as ethylenediaminetetraacetic acid, ethylenediaminetetraacetate or calcium EDTA, oxygen scavenger, such as methionine, ascorbic acid/ascorbate, citric acid/citrate, or albumin, and/or a preservative, such as preservative containing an aromatic ring (e.g. phenol or cresol). Exemplary stabilizers that are useful for compositions containing a hyaluronan degrading enzyme include detergents, such as polysorbates and proteins such as human serum albumin. Exemplary concentrations of serum albumin that are useful in the compositions herein include 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL, but can be more or less. Polysorbates also can be present in the compositions at, for example, concentrations of or about 0.001%, 0.002%, 0.003%, 0.004%, 0.005%, 0.006%, 00.007%, 0.008%, 0.009%, 0.01%, 0.02%, 0.03%, 0.04%, 0.05%, 0.06%, 0.07%, 0.08%, 0.09% or 0.1%. A metal chelating agent, such as calcium EDTA (CaEDTA), also can be present, such as for example, at concentrations of between approximately 0.02 mM to 20 mM, such as 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more. The pH and the osmolarity of the compositions can be adjusted by one of skill in the art to optimize the conditions for the desired activity and stability of the composition. In some examples, the compositions provided herein have an osmolarity of at or about 100 mOsm/kg, 120 mOsm/kg, 140 mOsm/kg, 160 mOsm/kg, 180 mOsm/kg, 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg, 400 mOsm/kg, 420 mOsm/kg, 440 mOsm/kg, 460 mOsm/kg, 500 or more mOsm/kg, and a pH of at or about 6, 6.2, 6.4, 6.6, 6.8, 7, 7.2, 7.4, 7.6, 7.8 or 8.

Generally NaCl is provided in formulations herein, for example, in an amount that is or is about 100 mM-150 mM or more. For example, an exemplary formulation can contain at or about 10 mM histidine and/or at or about 130 mM NaCl. Other formulations can contain in addition or alternatively lactose, for example, at or about 13 mg/ml. Additionally, an anti-bacterial or anti-fungal agent, including, but not limited to thiomersal, can be present in the formulation. Formulations can further contain Albumin, Pluronic® F68, TWEEN® and/or other detergent. The formulations are provided at a pH that is or is about 6.0, 6.1, 6.2, 6.3, 6.4, 6.5, 6.6, 6.7, 6.8, 6.9, 7.0, 7.1, 7.2, 7.3 or 7.4, generally that is or is about pH 6.5. Concentrated formulations of a modified soluble hyaluronidase for use herein are generally diluted in a saline solution or other salt buffered solution prior administration to maintain the appropriate salt concentration.

Injectables are designed for local and systemic administration. For purposes herein, local administration is desired for direct administration to the affected interstitium associated with accumulated or excess hyaluronan. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEENs 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

If administered intravenously, suitable carriers include physiological saline or phosphate buffered saline (PBS), and solutions containing thickening and solubilizing agents, such as glucose, polyethylene glycol, and polypropylene glycol and mixtures thereof.

The concentration of the pharmaceutically active compound is adjusted so that an injection provides an effective amount to produce the desired pharmacological effect. As discussed elsewhere herein, the modified soluble hyaluronidase is provided in a sufficient amount to maintain at or about 3 U/mL of the hyaluronidase in the plasma. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

b. Lyophilized Powders

Of interest herein are lyophilized powders, which can be reconstituted for administration as solutions, emulsions and other mixtures. They may also be reconstituted and formulated as solids or gels.

The sterile, lyophilized powder is prepared by dissolving a compound of a soluble hyaluronidase and/or second agent in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbital, fructose, corn syrup, xylitol, glycerin, glucose, sucrose or other suitable agent, in a suitable buffer, such as citrate, sodium or potassium phosphate or other such buffer known to those of skill in the art. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage (1 mg-1 g, generally 1-100 mg, such as 1-5 mg) or multiple dosages of the compound. The lyophilized powder can be stored under appropriate conditions, such as at about 4° C. to room temperature.

Reconstitution of this lyophilized powder with a buffer solution provides a formulation for use in parenteral administration. The precise amount depends upon the indication treated and selected compound. Such amount can be empirically determined.

c. Topical Administration

Topical mixtures are prepared as described for the local and systemic administration. The resulting mixture may be a solution, suspension, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof may be formulated as aerosols for topical application, such as by inhalation (see, e. q., U.S. Pat. Nos. 4,044,126, 4,414,209, and 4,364,923, which describe aerosols for delivery of a steroid useful for treatment inflammatory diseases, particularly asthma). These formulations for administration to the respiratory tract can be in the form of an aerosol or solution for a nebulizer, or as a microfine powder for insufflation, alone or in combination with an inert carrier such as lactose. In such a case, the particles of the formulation will typically diameters of less than 50 microns, preferably less than 10 microns.

The compounds may be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2M concentration with respect to the active compound. Formulations suitable for transdermal administration also can be delivered by iontophoresis (see, e.g., *Pharmaceutical Research* 3(6), 318 (1986)) and typically take the form of an optionally buffered aqueous solution of the active compound.

d. Compositions for Other Routes of Administration

Depending upon the condition treated other routes of administration, such as topical application, transdermal patches, oral and rectal administration also are contemplated herein. For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration.

Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,610; 4,769,027; 5,059,595; 5,073,543; 5,120,548; 5,354,566; 5,591,767; 5,639,476; 5,674,533 and 5,733,566).

Various delivery systems are known and can be used to administer selected compositions, such as but not limited to, encapsulation in liposomes, microparticles, microcapsules, recombinant cells capable of expressing the compound, receptor mediated endocytosis, and delivery of nucleic acid molecules encoding a soluble hyaluronidase or other agent such as retrovirus delivery systems.

Hence, in certain embodiments, liposomes and/or nanoparticles also can be employed with administration of compositions herein. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

2. Dosage and Administration

Active agents, for example a hyaluronan degrading enzyme, such as a hyaluronidase, and/or second agent, are included in an amount sufficient that exert a therapeutically useful effect in the absence of undesirable side effects on the patient treated. For example, as described elsewhere herein, the modified soluble hyaluronidase is formulated for systemic administration in a sufficient amount to maintain at least or about 3 U/mL in the plasma, generally 3 U/mL-12 U/mL or more, for example, from about or at a level of 4 U/mL, 5 U/mL, 6 U/mL, 7 U/mL, 8 U/mL, 9 U/mL, 10 U/mL, 11 U/mL, 12 U/mL, 13 U/mL, 14 U/mL, 15 U/mL, 16 U/mL, 17 U/mL, 18 U/mL, 19 U/mL, 20 U/mL, 25 U/mL, 30 U/mL, 35 U/mL, 40 U/mL, 45 U/mL, 50 U/mL or more.

It is within the level of one of skill in the art to determine the amounts of modified hyaluron-degrading enzyme, for example, modified soluble hyaluronidase to maintain at least 3 U/mL of the hyaluronidase in the blood. The level of hyaluronidase in the blood can be monitored over time in order to ensure that a sufficient amount of the hyaluronidase is present in the blood. Any assay known to one of skill in the art to measure the hyaluronidase in the plasma can be performed. For example, a microturbidity assay or enzymatic assay described in the Examples herein can be performed on protein in plasma. It is understood that plasma normally contains hyaluronidase enzymes. Such plasma hyaluronidase enzymes typically have activity at an acidic pH (U.S. Pat. No. 7,105,330). Hence, before treatment of with a modified enzyme, the plasma levels of hyaluronidase should be determined and used as a baseline. Subsequent measurements of plasma hyaluronidase levels after treatment can be compared to the levels before treatments. Alternatively, the assay can be performed under pH conditions that suppress endogenous lysosomal hyaluronidase activity in plasma, which normally exhibits activity at acidic pH. Thus, where the modified soluble hyaluronidase is active at neutral pH (e.g. human PH20), only the level of the modified neutral-active soluble hyaluronidase is measured.

The composition containing the active agent can include a pharmaceutically acceptable carrier. Therapeutically effective concentration can be determined empirically by testing the compounds in known in vitro and in vivo systems, such as the assays provided herein. The concentration of a hyaluronan degrading enzyme such as a soluble hyaluronidase or second agent in the composition depends on absorption, inactivation and excretion rates of the complex, the physicochemical characteristics of the complex, the dosage schedule, and amount administered as well as other factors known to those of skill in the art. For example, it is understood that the precise dosage and duration of treatment is a function of the tissue being treated and may be determined empirically using known testing protocols or by extrapolation from in vivo or in vitro test data and/or can be determined from known dosing regimes of the particular agent. For example, agents and treatments for treatment of hyaluronan-associated diseases and conditions, such as anti-cancer agents, are well known in the art. Thus, dosages of second agents in a composition can be chosen based on standard dosing regimes for that agent under a given route of administration.

It is to be noted that concentrations and dosage values may also vary with the age of the individual treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

The amount of a hyaluronan degrading enzyme, such as a soluble hyaluronidase, to be administered for the treatment of a disease or condition, for example a hyaluronan-associated disease or condition such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease. Exemplary dosage range is at or about 50 Units to 50,000,000 Units of a soluble hyaluronidase conjugated to a polymer, or a functionally equivalent amount of another hyaluronan degrading enzyme conjugated to a polymer. It is understood herein that a unit of activity is normalized to a standard activity, for example, an activity as measured in a microturbidity assay assaying hyaluronidase activity.

A soluble hyaluronidase conjugated to a polymer, for example a pegylated soluble hyaluronidase, can exhibit lower activity per mg of total protein, i.e. exhibits a lower specific activity, compared to a native soluble hyaluronidase not so conjugated. For example, as described elsewhere herein, an exemplary rHuPH20 preparation exhibits a specific activity of 120,000 Units/mg, while a pegylated form of rHuPH20 exhibits a specific activity of 30,000 Units/mg. Typically, a PEGylated form of rHuPH20 exhibits a specific activity within the range of between at or about 26,000 and at or about 38,000 U/mg. Hence, to achieve an equal unit of activity, a greater of amount of total protein is required. For example, a hyaluronan degrading enzyme, such as a soluble hyaluronidase, conjugated to a polymer requires 1.5 time, 3 times, 4 times, 5 times, 6 times, 7 times, 8 times, 9 times, 10 times or more total protein (in mg) to achieve the same units of activity of a hyaluronan degrading enzyme, such as a soluble hyaluronidase, that is not so conjugated. For purposes herein, however, dosages are with reference to Units.

Thus, for example, a soluble hyaluronidase provided herein conjugated to polymer, for example, a PEG, can be administered at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units. In instances where a hyaluronan degrading enzyme that is not a hyaluronidase is conjugated to a polymer, it can be administered at an amount that is functionally equivalent to at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units.

Generally, for purposes herein to maintain at least 3 U/mL of the hyaluronidase in plasma, at or about 0.02 mg/kg (of the subject), 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg or more is administered. Generally, where the specific activity of the modified hyaluronidase is or is about 20,000 U/mg to 60,000 U/mg, generally at or about 35,000 U/mg, 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more is administered.

Typically, volumes of injections or infusions of hyaluronidase contemplated herein are from at or about 0.5 ml, 1 ml, 2 ml, 3 ml, 4 ml, 5 ml, 6 ml, 7 ml, 8 ml, 9 ml, 10 ml, 15 ml, 20 ml, 30 ml, 40 ml, 50 ml or more. The hyaluronan degrading enzyme, such as a hyaluronidase can be provided as a stock solution at or about 50 U/ml, 100 U/ml, 150 U/ml, 200 U/ml, 400 U/ml or 500 U/ml (or a functionally equivalent amount) or can be provided in a more concentrated form, for example at or about 1000 U/ml, 1500 Units/ml, 2000 U/ml, 4000 U/ml or 5000 U/ml for use directly or for dilution to the effective concentration prior to use. The volume of hyaluronan degrading enzyme, such as soluble hyaluronidase, administered is a function of the dosage required, but can be varied depending on the concentration of a hyaluronan degrading enzyme, such as soluble hyaluronidase, stock formulation available. For example, it is contemplated herein that hyaluronan degrading enzyme, such as soluble hyaluronidase, is not administered in volumes greater than about 50 ml, and typically is administered in a volume of 5-30 ml, generally in a volume that is not greater then about 10 mL. A syringe pump can be used for the higher volumes, at the discretion of the physician. The timing of administration can also be adjusted by the treating physician. For example, when administered intravenously, a syringe pump can be used to administer the composition over a time period that is 1 minute, 2, 3, 4, 5, 6, 7, 8, 9, 10, 11, 12, 13, 14, 15, 20, 25, 30, or more minutes, generally at or about 15 minutes. The hyaluronan degrading enzyme, such as soluble hyaluronidase, can be provided as a liquid or lyophilized formulation. Lyophilized formulations are ideal for storage of large unit doses of hyaluronan degrading enzyme.

In one example, the hyaluronan degrading enzyme, such as soluble hyaluronidase, is administered as part of a combination therapy, by administering the hyaluronan-degrading enzyme and a second agent or treatment for treating the disease or condition. In one example, the hyaluronan-degrading enzyme and second agent or treatment can be co-formulated and administered together. In another example, the hyaluronan degrading enzyme, such as soluble hyaluronidase, is administered subsequently, intermittently or simultaneously with the second agent or treatment preparation. Generally, the hyaluronan degrading enzyme is administered prior to administration of the second agent or treatment preparation to permit the hyaluronan degrading enzyme to degrade the hyaluronic acid in a cell, tissue or fluid of the subject, such as, for example, the interstitial space, extracellular matrix, tumor tissue, blood or other tissue. For example, the hyaluronan degrading enzyme, such as soluble hyaluronidase, can be administered 0.5 minutes, 1 minute, 2 minute, 3 minute, 4 minute, 5 minute, 6 minute, 7 minutes, 8 minutes, 9 minutes, 10 minutes, 20 minutes, 30 minutes, 1 hour or more prior to administration of the second agent preparation. In some examples, the hyaluronan degrading enzyme is administered together with the second agent preparation. As will be appreciated by those of skill in the art, the desired proximity of co-administration depends in significant part in the effect half lives of the agents in the particular tissue setting, and the particular disease being treated, and can be readily optimized by testing the effects of administering the agents at varying times in suitable models, such as in suitable animal models. In some situations, the optimal timing of administration of the hyaluronan degrading enzyme, such as a hyaluronidase, will exceed 60 minutes.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimes for second agents/treatments herein are known to one of skill in the art.

3. Combination Therapies

Any of the compositions or combinations described herein can be further co-formulated or co-administered together with, prior to, intermittently with, or subsequent to, other therapeutic or pharmacologic agents or treatments, such as procedures, for example, agents or treatments to treat hyaluronan-associated cancers. Such agents include, but are not limited to, other biologics, small molecule compounds, dispersing agents, anesthetics, vasoconstrictors and surgery, and combinations thereof. Such other agents and treatments that are available for the treatment of a disease or condition, including all those exemplified herein, are known to one of skill in the art or can be empirically determined. In another example, a local anesthetic, for example, lidocaine can be administered to provide pain relief. In some examples, the anesthetic can be provided in combination with a vasoconstrictor to increase the duration of the anesthetic effects.

Thus, in one example, compositions provided herein can be co-formulated or co-administered with a local anesthesia. Anesthesias include short-acting and long-lasting local anesthetic drug formulations. Short-acting local anesthetic drug formulations contain lidocaine or a related local anesthetic drug dissolved in saline or other suitable injection vehicle. Typically, local anesthesia with short-acting local anesthetics last approximately 20-30 minutes. Exemplary anesthetics include, for example, non-inhalation local anesthetics such as ambucaines; amoxecaines; amylocalnes; aptocaines; articaines; benoxinates; benzyl alcohols; benzocaines; betoxycaines; biphenamines; bucricaines; bumecaines; bupivacaines; butacaines; butambens; butanilicaines; carbizocaines; chloroprocaine; clibucaines; clodacaines; cocaines; dexivacaines; diamocaines; dibucaines; dyclonines; elucaines; etidocaines; euprocins; fexicaines; fomocaines; heptacaines; hexylcaines; hydroxyprocaines; hydroxytetracaines; isobutambens; ketocaines; leucinocaines; lidocaines; mepivacaines; meprylcaines; octocaines; orthocaines; oxethacaines; oxybuprocaines; phenacaines; pinolcaines; piperocaines; piridocaines; polidocanols; pramocaines; prilocalnes; procaines; propanocaines; propipocaines; propoxycaines; proxymetacaines; pyrrocaines; quatacaines; quinisocaines; risocaines; rodocaines; ropivacaines; salicyl alcohols; suicaines; tetracaines; trapencaines; and trimecaines; as well as various other non-inhalation anesthetics such as alfaxalones; amolanones; etoxadrols; fentanyls; ketamines; levoxadrols; methiturals; methohexitals; midazolams; minaxolones; propanidids; propoxates; pramoxines; propofols; remifentanyls; sufentanyls; tiletamines; and zolamine. The effective amount in the formulation will vary depending on the particular patient, disease to be treated, route of administration and other considerations. Such dosages can be determined empirically.

Due to the short half-life of local anesthetics, it is often desirable to co-administer or co-formulate such anesthetics with a vasoconstrictor. Examples of vasoconstrictors include alpha adrenergic receptor agonists including catecholamines and catecholamine derivatives. Particular examples include, but are not limited to, levonordefrin, epinephrine and norepinephrine. For example, a local anesthetic formulation, such as lidocaine, can be formulated to contain low concentrations of epinephrine or another adrenergic receptor agonist such as levonordefrin. Combining local anesthetics with adrenergic receptor agonists is common in pharmaceutical preparations (see e.g., U.S. Pat. Nos. 7,261,889 and 5,976, 556). The vasoconstrictor is necessary to increase the half-life of anesthetics. The vasoconstrictor, such as epinephrine, stimulates alpha-adrenergic receptors on the blood vessels in the injected tissue. This has the effect of constriction the blood vessels in the tissue. The blood vessel constriction causes the local anesthetic to stay in the tissue much longer, resulting in a large increase in the duration of the anesthetic effect.

Generally, a vasoconstrictor is used herein in combination with an anesthetic. The anesthetic agent and vasoconstrictor can be administered together as part of a single pharmaceutical composition or as part of separate pharmaceutical compositions so long as the vasoconstrictor acts to constrict the blood vessels in the vicinity of whether the anesthetic agent has been administered to result in a prolonging of anesthesia. In one example, the anesthetic agent and vasoconstrictor are administered together in solution. In addition, the anesthetic agent and vasoconstrictor can be formulated together or separate from the compositions provided herein. Single formulations are preferred. The anesthetic agent and vasoconstrictor can be administered by injection, by infiltration or by topical administration, e.g., as part of a gel or paste. Typically, the anesthetic agent and vasoconstrictor are administered by injection directly into the site to be anesthetized, for example, by subcutaneous administration. The effective amount in the formulation will vary depending on the particular patient, disease to be treated, route of administration and other considerations. Such dosages can be determined empirically. For example, exemplary amounts of lidocaine is or is about 10 mg to 1000 mg, 100 mg to 500 mg, 200 mg to 400 mg, 20 mg to 60 mg, or 30 mg to 50 mg. The dosage of lidocaine administered will vary depending on the individual and the route of administration. Epinephrine can be administered in amounts such as, for example, 10 μg to 5 mg, 50 μg to 1 mg, 50 μg to 500 μg, 50 μg to 250 μg, 100 μg to 500 μg, 200 μg to 400 μg, 1 mg to 5 mg or 2 mg to 4 mg. Typically, epinephrine can be combined with lidocaine in a 1:100,000 to 1:200,000 dilution, which means that 100 ml of anesthetic contains 0.5 to 1 mg of epinephrine. Volumes administered can be adjusted depending on the disease to be treated and the route of administration. Exemplary of volumes include 1-100 ml, 1-50 ml, 10-50 ml, 10-30 ml, 1-20 ml, or 1-10 ml, typically 10-50 ml of an anesthetic/vasoconstrictor formulation. The administration can be subsequently, simultaneously or intermittently with administration of compositions of soluble hyaluronidases and other agents provided herein.

4. Packaging and Articles of Manufacture

Also provided are articles of manufacture containing packaging materials, a pharmaceutical composition that is effective for treating a hyaluronan-associated disease or condition, and a label that indicates that the composition and combinations are to be used for treating a hyaluronan-associated disease or condition. In one example, the pharmaceutical composition contains the hyaluronan-degrading enzyme, and no second agent or treatment. In another example, the article of manufacture contains the hyaluronan-degrading enzyme and a second agent or agents or treatment or treatments. In this example, the pharmaceutical compositions of a second agent and a hyaluronan degrading enzyme, such as a soluble hyaluronidase, can be provided together or separately, for packaging as articles of manufacture. Exemplary of articles of manufacture are containers including single chamber and dual chamber containers. The containers include, but are not limited to, tubes, bottles and syringes. The containers can further include a needle for subcutaneous administration.

The articles of manufacture provided herein contain packaging materials. Packaging materials for use in packaging pharmaceutical products are well known to those of skill in the art. See, for example, U.S. Pat. Nos. 5,323,907, 5,033, 252 and 5,052,558, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any hyaluronan-associated disease or condition.

Compositions effective for treating a hyaluronan-associated disease or condition (e.g. composition(s) containing a hyaluronan degrading enzyme, such as a soluble hyaluronidase, and/or a second agent or treatment, provided together or separately), also can be provided as kits. Kits can include a pharmaceutical composition described herein and an item for administration. For example compositions can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of hyaluronan.

G. METHODS OF ASSESSING ACTIVITY, BIOAVAILABILITY AND PHARMACOKINETICS

Assays can be used to assess whether a subject has a markers that are associated with hyaluronan-associated diseases, conditions or disorders and is therefore amendable to treatment using the methods provided herein. Such assays can include measuring the amount of hyaluronan, measuring interstitial fluid pressure, vascular volume and water content. Assays also can be used to assess the in vitro and in vivo activities of a hyaluronan degrading enzyme, including a soluble hyaluronidase, as well as the in vitro and in vivo activities of other agents, such as, for example, chemotherapeutic agents, in the presence and/or absence of a hyaluronan degrading enzyme, such as a soluble modified hyaluronidase. Included among such assays are those that assess the pharmacokinetic properties of an agent that is co-administered with a modified hyaluronan degrading enzyme, such as a PEGylated hyaluronan degrading enzyme (e.g. PEGylated soluble hyaluronidase) including bioavailability, and tolerability. Such assays can be used, for example, to determine appropriate dosages of modified hyaluronan degrading enzyme and, optionally, a co-administered agent, such as a chemotherapeutic, and the frequency of dosing, for treatment.

1. Assays to Assess the Activity of Hyaluronan Degrading Enzymes

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity. In another example, hyaluronidase activity is measured using a microtiter assay in which residual biotinylated hyaluronic acid is measured following incubation with hyaluronidase (see e.g. Frost and Stem (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) Anal. Biochem. 229:35-41; Takahashi et al., (2003) Anal. Biochem. 322:257-263).

The ability of a hyaluronan degrading enzyme, such as a modified soluble hyaluronidase (eg PEGylated rHuPH20) to act as a spreading or diffusing agent also can be assessed. For example, trypan blue dye can be injected, such as subcutaneously or intradermally, with or without a hyaluronan degrading enzyme into the lateral skin on each side of nude mice. The dye area is then measured, such as with a microcaliper, to determine the ability of the hyaluronan degrading enzyme to act as a spreading agent (see e.g. U.S. Published Patent No. 20060104968). The effect of co-administration of a hyaluronan degrading enzyme, such as a hyaluronidase, with another agent, such as a chemotherapeutic, on the pharmacokinetic and pharmacodynamic properties of that agent also can be assessed in vivo using animal model and/or human subjects, such as in the setting of a clinical trial, as discussed above and demonstrated in Example 1, below. The functional activity of a hyaluronan degrading enzyme that is not a hyaluronidase can be compared to a hyaluronidase using any of these assays. This can be done to determine what a functionally equivalent amount of a hyaluronan degrading enzyme is. For example, the ability of a hyaluronan degrading enzyme to act as a spreading or diffusing agent can be assessed by injecting it (e.g. subcutaneously or intradermally) into the lateral skin of mice with trypan blue, and the amount required to achieve the same amount of diffusion as, for example, 100 units of a Hyaluronidase Reference Standard, can be determined. The amount of hyaluronan degrading enzyme required is, therefore, functionally equivalent to 100 hyaluronidase units. The hydraulic conductivity (K), such as in a tumor, before and after treatment with a modified hyaluronan degrading enzyme, such as a modified hyaluronidase, also can be measured to assess the activity of a modified hyaluronan degrading enzyme preparation.

The ability of a modified hyaluronan degrading enzyme, such as a modified hyaluronidase, including pegylated hyaluronidase, to affect any one or more of the markers associated with hyaluronan-associated diseases and disorders described above, or any other associated markers or phenotypes, can be assessed using any one or more of the assays described above. For example, the ability of a modified hyaluronan degrading enzyme, such as a modified hyaluronidase, to reduce hyaluronan levels or content, formation or size of halos, interstitial fluid pressure, water content and/or vascular volume can be assessed using any one or more of the assays above in vitro, ex vivo and/or in vivo. In one example, a modified hyaluronidase can be administered to a subject with a tumor or an appropriate animal model and the effect on hyaluronan levels, formation or size of halos, interstitial fluid pressure, water content and/or vascular volume assessed and compared to subjects or animal models not administered modified hyaluronidase. In some examples, the modified hyaluronidase can be administered with another agent, such as a chemotherapeutic agent.

2. Pharmacokinetics and Tolerability

Pharmacokinetic and tolerability studies can be performed using animal models or can be performed during clinical studies with patients to assess the effect of co-administration with a modified hyaluronan degrading enzyme, such as a modified hyaluronidase, on the properties of an agent, such as a chemotherapeutic agent. Animal models include, but are not limited to, mice, rats, rabbits, dogs, guinea pigs and non-human primate models, such as cynomolgus monkeys or rhesus macaques. In some instances, pharmacokinetic and tolerability studies are performed using healthy animals. In other examples, the studies are performed using animal models of a disease for which therapy with hyaluronan is considered, such as animal models of any with hyaluronan-associated diseases and disorders.

The pharmacokinetic properties of, for example, a chemotherapeutic agent co-administered with modified hyaluronan degrading enzyme, such as a modified hyaluronidase, can be assessed by measuring such parameters as the maximum (peak) chemotherapeutic agent concentration ($C_{max}$), the peak time (i.e. when maximum chemotherapeutic agent concentration occurs; $T_{max}$), the minimum chemotherapeutic agent concentration (i.e. the minimum concentration between doses of chemotherapeutic agent; $C_{min}$), the elimination half-life ($T_{1/2}$) and area under the curve (i.e. the area under the curve generated by plotting time versus concentration; AUC), following administration. In instances where the chemotherapeutic agent is administered subcutaneously, the absolute bioavailability of the agent is determined by comparing the area under the curve of chemotherapeutic agent following subcutaneous delivery ($AUC_{sc}$) with the AUC of chemotherapeutic agent following intravenous delivery ($AUC_{iv}$). Absolute bioavailability (F), can be calculated using the formula: $F=([AUC]_{sc} \times dose_{sc})/([AUC]_{iv} \times dose_{iv})$. The concentration of chemotherapeutic agent in the plasma following subcutaneous administration can be measured using any method known in the art suitable for assessing concentrations of chemotherapeutic agent in samples of blood.

A range of doses and different dosing frequency of dosing can be administered in the pharmacokinetic studies to assess the effect of increasing or decreasing concentrations of the co-administered agent, such as chemotherapeutic agent and/or modified hyaluronan degrading enzyme (e.g. PEGylated rHuPH20) in the dose. Pharmacokinetic properties of subcutaneously administered chemotherapeutic, such as bioavailability, also can be assessed with or without co-administration of modified hyaluronidase. For example, dogs, such as beagles, can be administered a chemotherapeutic in combination with modified hyaluronan degrading enzyme, such as a modified hyaluronidase, or alone, using one or more routes of administration. Such studies can be performed to assess the effect of co-administration with hyaluronidase on pharmacokinetic properties, such as bioavailability, of chemotherapeutic agents.

Studies to assess safety and tolerability also are known in the art and can be used herein. Following administration of a co-administered agent, such as a chemotherapeutic agent, with or without co-administration of modified hyaluronan degrading enzyme, such as a modified hyaluronidase, the development of any adverse reactions can be monitored. Adverse reactions can include, but are not limited to, injection site reactions, such as edema or swelling, headache, fever, fatigue, chills, flushing, dizziness, urticaria, wheezing or chest tightness, nausea, vomiting, rigors, back pain, chest pain, muscle cramps, seizures or convulsions, changes in blood pressure and anaphylactic or severe hypersensitivity responses. Typically, a range of doses and different dosing frequencies are be administered in the safety and tolerability studies to assess the effect of increasing or decreasing concentrations of chemotherapeutic agent and/or modified hyaluronan degrading enzyme (e.g a modified hyaluronidase) in the dose.

3. Animal Models

Animal models of hyaluronan-associated diseases, disorders or conditions can be utilized to assess the in vivo affect of administration of modified hyaluronan degrading enzymes, such as modified hyaluronidases, with or without co-administration of another agent, such as a chemotherapeutic agent. Exemplary hyaluronan-associated diseases for which an appropriate animal model can be utilized include solid tumors, for example, late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and disorders are disc pressure, cancer and edema, for example, edema caused by organ transplant, stroke, brain trauma or other injury.

Animal models can include, but are not limited to, mice, rats, rabbits, dogs, guinea pigs and non-human primate models, such as cynomolgus monkeys or rhesus macaques. In some examples, immunodeficient mice, such as nude mice or SCID mice, are transplanted with a tumor cell line from a hyaluronan-associated cancer to establish an animal model of that cancer. Exemplary cell lines from hyaluronan-associated cancers include, but are not limited to, PC3 prostate carcinoma cells, BxPC-3 pancreatic adenocarcinoma cells, MDA-MB-231 breast carcinoma cells, MCF-7 breast tumor cells, BT474 breast tumor cells, Tramp C2 prostate tumor cells and Mat-LyLu prostate cancer cells, and other cell lines described herein that are hyaluronan associated, e.g. contain elevated levels of hyaluronan. Modified hyaluronidase can then be administered to the mice to assess the effect on, for example, hyaluronan levels or content, formation or size of halos, interstitial fluid pressure, water content and/or vascular volume. In some examples, a chemotherapeutic is co-administered with the modified hyaluronan degrading enzyme, such as a modified soluble hyaluronidase, and the effect on, for example, pharmacokinetics, tumor size or morbidity is assessed.

H. USE OF HYALURONAN DEGRADING ENZYMES IN TREATING HYALURONAN-ASSOCIATED CONDITIONS, DISEASES AND DISORDERS

The methods described herein include methods for therapeutic uses of hyaluronan degrading enzymes. The therapeutic uses described below are exemplary and do not limit the applications of the methods described herein.

The provided methods include methods for use of the hyaluronan-degrading enzymes to treat any hyaluronan-associated disease or condition, including, but not limited to, hyaluronan-rich cancers, and other diseases associated with hyaluronan, such as other diseases associated with elevated interstitial fluid pressure, such as diseases associated with disc pressure, and edema, for example, edema caused by organ transplant, stroke, brain trauma or other injury or other edemas and other hyaluronan associated diseases and conditions.

The hyaluronan-rich cancers include cancers associated with elevated interstitial fluid pressure, solid tumors, late-stage cancers, metastatic cancers, undifferentiated cancers, such as, but not limited to, ovarian cancer, in situ carcinoma (ISC), squamous cell carcinoma (SCC), prostate cancer, pancreatic cancer, non-small cell lung cancer, breast cancer, colon cancer, brain cancer and other cancers.

The therapeutic uses include administration of the compositions, alone or in combination with other treatments or agents, for treatment of a hyaluronan-associated disease or condition, including cancer treatment, reduction in tumor volume, increased sensitivity to chemotherapy or other cancer treatment, enhancing bioavailability or delivery of a cancer treating or other treating agent, decreasing interstitial fluid pressure, increasing vascular volume, decreasing water content in a tissue in the subject, and other treatments.

The methods also include selection of subjects for treatment, e.g. prior to treatment of the subject, for example to determine whether the subject has a hyaluronan-associated disease or condition, for example, by using a method for assaying the expression of hyaluronan or associated molecule, for example, using the methods described in Example 3(a), below, such as determining the expression of HA compared to a control, such as a control tissue, cell, fluid or other sample, for example, tissues, cells, fluids from normal subjects (e.g. subjects without a hyaluronan-associated disease), a sample (e.g. cell line) known to express low levels of hyaluronan, such as exemplary tumor cell lines described herein, for example, the HCT 116 cell line, the HT29 cell line, the NCI H460 cell line, the DU145 cell line, the Capan-1 cell line, and tumors from tumor models generated using such cell lines (see, e.g. Example 17A).

In this example, expression of one or more markers, for example, hyaluronan, or HAS2, is measured in a sample from the subject and, optionally, compared to another sample or a standard. Following the measurement, it is determined whether the disease or condition is a hyaluronan-associated disease or condition. In one example, the method further includes treatment, for example, administration of a soluble hyaluronidase-containing composition alone or in combination with one or more other treatments. The methods further include assessment of treatment, such as by measuring the levels of hyaluronan in a cell, tissue or fluid of a subject, 1. Hyaluronan-Associated Conditions and Diseases Provided herein are methods for treating hyaluronan-associated diseases and conditions by administration of a composition containing a hyaluronan degrading enzyme, such as a hyaluronidase, for example, a soluble hyaluronidase, typically a soluble hyaluronidase that is modified by conjugation to a polymer (for example, to increase half-life), either alone or in combination with or in addition to another treatment and/or agent.

Hyaluronan-associated conditions and diseases are diseases and conditions in which hyaluronan levels are elevated as cause, consequence or otherwise observed in the disease or condition, and can be treated by administration of a composition containing a hyaluronan degrading enzyme, such as a hyaluronidase, for example, a soluble hyaluronidase, either alone or in combination with or in addition to another treatment and/or agent.

Typically, hyaluronan-associated diseases and conditions are associated with elevated hyaluronan expression in a tissue, cell, or body fluid (e.g. tumor tissue or tumor-associated tissue, blood, or interstitial space) compared to a control, e.g. another tissue, cell or body fluid. The elevated hyaluron expression can be elevated compared to a normal tissue, cell or body fluid, for example, a tissue, cell or body fluid that is analogous to the sample being tested, but isolated from a different subject, such as a subject that is normal (i.e. does not have a disease or condition, or does not have the type of disease or condition that the subject being tested has), for example, a subject that does not have a hyaluronan-associated disease or condition. The elevated hyaluronan expression can be elevated compared to an analogous tissue from another subject that has a similar disease or condition, but whose disease is not as severe and/or is not hyaluronan-associated or expresses relatively less hyaluronan and thus is hyaluronan-associated to a lesser degree. For example, the subject being tested can be a subject with a hyaluronan-associated cancer, where the HA amounts in the tissue, cell or fluid are relatively elevated compared to a subject having a less severe cancer, such as an early stage, differentiated or other type of cancer. In another example, the cell, tissue or fluid contains elevated levels of hyaluronan compared to a control sample, such as a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines (see, e.g. Example 17A).

In some cases, hyaluronan-associated diseases and conditions are associated with increased interstitial fluid pressure, decreased vascular volume, and/or increased water content in a tissue, such as a tumor. In one example, treatment with the compositions and compounds provided herein ameliorates one or more of these symptoms or other symptoms associated with the disease or condition, for example, improves survival or quality of life of the subject over time, or inhibits tumor growth.

Exemplary hyaluronan-associated diseases and conditions that can be treated using the provided enzymes, compositions and methods, include, but are not limited to, hyaluronan-rich cancers, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

Typically, the hyaluronan-associated disease or condition is associated with increased HA expression, for example, in a diseased tissue, for example, a tumor. In one example, HALOs (pericellular matrix regions that are rich in proteoglycans, including hyaluronan) form in a tissue of the subject, for example, in a diseased tissue. In another example, the presence of HALOs is detected in an in vitro culture of cells from a tissue of the subject, for example, a diseased tissue.

In one example, the hyaluronan-associated condition, disease or disorder is associated with increased interstitial fluid pressure, decreased vascular volume, or increased water content in a tissue. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

Cancers, Including Hyaluronan-Rich Cancers

Hyaluronan plays a role in processes associated with cell motility, including development, regeneration, repair, embryogenesis, embryological development, wound healing, angiogenesis, and tumorigenesis (Toole 1991 Cell Biol. Extracell. Matrix, Hay (ed.), Plenum Press, New York, 1384-1386; Bertrand et al. 1992 Int. J. Cancer 52:1-6; Knudson et al, 1993 FASEB J. 7:1233-1241). In addition, hyaluronan levels correlate with tumor aggressiveness (Ozello et al. 1960 Cancer Res. 20:600-604; Takeuchi et al. 1976, Cancer Res. 36:2133-2139; Kimata et al. 1983 Cancer Res. 43:1347-1354); hyaluronan promotes several cancer processes, including, but not limited to, tumor growth, survival, metastasis and interstitial fluid pressure. Exemplary of the hyaluronan-associated diseases and conditions that can be treated using the provided compositions containing soluble hyaluronidase and methods are cancers, particularly hyaluronan-rich cancers, for example, hyaluronan-rich cancers that are associated with elevated interstitial fluid pressure.

Hyaluronan-associated cancers are cancers associated with hyaluronan-expression, typically elevated hyaluronan expression, which can be determined, for example, prior to treatment, as described in the sections below.

For example, the hyaluronan-rich cancer can be a cancer in which the cancer cells produce HALOs in an in vitro particle exclusion assay, as described in Example 6A, cancers that have elevated expression of hyaluronan (as determined by immunostaining, e.g. histological staining of sections from the tumor), cancers that have elevated HAS2 (Hyaluronan synthase 2), cancers that do not produce hyaluronidase (HYAL1) in vitro, as determined, for example, using the enzymatic assay described in Example 2. Hyaluronan-rich cancers can be identified by any method for assessing hyaluronan expression, for example, assays as provided in Section 3(a), below, and other known methods for assaying protein/mRNA expression.

Several hyaluronan-rich cancers have been identified. In some cases, hyaluronan expression correlates with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Maarit et al., *Cancer Research,* 60:150-155 (2000); Karvinen et al., *British Journal of Dermatology,* 148:86-94 (2003); Lipponen et al., *Eur. Journal of Cancer,* 849-856 (2001); Pirinen et al., *Int. J. Cancer:* 95: 12-17 (2001); Auvinen et al., *American Journal of Pathology,* 156(2):529-536 (2000); Ropponen et al., *Cancer Research,* 58: 342-347 (1998)). Thus, hyaluronan-rich cancers can be treated by administration of a hyaluronan degrading enzyme, such as a hyaluronidase, to treat one or more symptoms of the cancer. Hyaluronan-rich tumors include, but are not limited to, prostate, breast, colon, ovarian, stomach, head and neck and other tumors and cancers.

For example, hyaluronidase has direct anticarcinogenic effects when injected into tumors. Hyaluronidase prevents growth of tumors transplanted into mice (De Maeyer et al., (1992) Int. J. Cancer 51:657-660) and inhibits tumor formation upon exposure to carcinogens (Pawlowski et al. (1979) Int. J. Cancer 23:105-109) Hyaluronidase is effective as the sole therapeutic agent in the treatment of brain cancer (gliomas) (WO 198802261).

Thus, provided are enzymes, compositions and combinations containing hyaluronan-degrading enzymes, such as modified soluble hyaluronidases, for treating cancers, typically hyaluronan-associated cancers.

2. Uses in Treating Hyaluronan-Associated Diseases and Conditions

Provided are methods for treating hyaluronan-associated diseases and conditions. The methods include administration of the compositions, alone or in combination with other treatments or agents, for treatment of a hyaluronan-associated disease or condition, including cancer treatment, reduction in tumor volume, increased sensitivity to chemotherapy or other cancer treatment, enhancing bioavailability or delivery of a cancer treating or other treating agent, decreasing interstitial fluid pressure, increasing vascular volume, decreasing water content in a tissue in the subject, and other treatments.

The methods also include selection of subjects for treatment, e.g. prior to treatment of the subject, for example to determine whether the subject has a hyaluronan-associated disease or condition, for example, by using a method for assaying the expression of hyaluronan or associated molecule, for example, using the methods described in Example b, below. In this example, expression of one or more markers, for example, hyaluronan, or HAS2, is measured in a sample from the subject and, optionally, compared to another sample or a standard. Following the measurement, it is determined whether the disease or condition is a hyaluronan-associated disease or condition. In one example, the method further includes treatment, for example, administration of a soluble hyaluronidase-containing composition alone or in combination with one or more other treatments.

Among the provided methods are methods for decreasing interstitial fluid pressure in a tissue of a subject with a hyaluronan-associated disease or disorder, for example, a hyaluronan-associated cancer, by administration of the compositions containing the soluble hyaluronidase. Typically, the reduction of the IFP is sustained, for example, for 24, 48, or 72 hours. Also provided are methods for increasing vascular volume in a tissue of the subject by administering the compositions, typically for sustained decrease of the vascular volume, for example, for at least 24, 48 or 72 or more hours. Also provided are methods for decreasing water content in a tissue of the subject using the compositions, where the effects typically are sustained, for example, for at least 24, 48, or 72 or more hours. Also provided are methods for reducing hyaluronan expression in the subject using the compositions, for example, to reduce pericellular matrix HALOs in a tissue of the subject. Typically, the reduction is sustained, for example, for at least 24, 48, 72 or more hours, following administration.

a. Detection Of Hyaluronan-Associated Disease Markers (Selection of Subjects for Treatment and Assessing Treatment Effects)

The methods include steps for selecting subjects for treatment with hyaluronan degrading enzymes and for assessing treatment effects, such as efficacy of treatment. Such methods include methods for detecting hyaluronan-associated disease markers, which include any indication that a subject has a hyaluronan-associated disease, that the subject is likely to respond to treatment by hyaluronan degrading enzyme, and/or that a sample from the subject, such as a tissue, cell or fluid, contains elevated hyaluronan expression. Exemplary assays for detecting markers are described below, and include assays for measuring HA expression and/or relative HA expression in a sample from a subject, assays for analyzing effects of hyaluronan-degrading enzymes on a sample from the subject, and assays for measuring readouts typically associated with certain hyaluronan-associated diseases/conditions, such as low hyaluronidase expression or activity, high interstitial fluid pressure, vascular volume and water content. In general, any known assay for detection of proteins or nucleic acids in samples from subjects, or for assessing the effects of treatment on cells/tissues in vitro can be used.

Subjects selected for treatment in the methods provided herein include subjects having elevated, aberrant or accumulated expression of hyaluronan compared to subjects not having the disease or condition or compared to normal tissues or samples that do not have elevated, aberrant or accumulated expression of HA. Any sample or tissue from a subject can be tested and compared to a normal sample or tissue. Hyaluronan levels can be measured from any source such as from a tissue (e.g. by biopsy), tumor, cells, or from blood, serum, urine or other body fluids. For example, as described elsewhere herein, profiles of HA deposition in solid tumors have generally been categorized as pericellular or stromal. Elevated plasma levels of HA have been observed most notably in patients with Wilm's tumor, mesothelioma and liver metastases. Thus, depending on the disease or condition, a different sample can be measured for hyaluronan levels. The choice of sample is within the level of one of skill in the art.

The assay used to measure hyaluronidase substrate levels is a function of the disease or condition and can be chosen based on the particular disease or condition. One of skill in the art is familiar with methods of detecting hyaluronan, which include, but are not limited to, immunohistochemistry methods, ELISA methods, as described in section (i) below.

In one example, the step for detecting markers is performed prior to treating a subject, for example, to determine whether the subject has a hyaluronan-associated condition or disease that will be amenable to treatment with a hyaluronan-degrading enzyme. In this example, if the marker is detected (e.g. if it is determined that a cell, tissue or fluid from the patient contains elevated hyaluronan expression or is responsive to hyaluronan degrading enzyme), a treatment step is performed, where a hyaluronan-degrading enzyme is administered to the subject. In one example, when the marker is not detected (e.g. if it is determined that a cell, tissue or fluid from the patient contains normal or non-elevated hyaluronan expression or is not responsive to hyaluronan degrading enzyme) another treatment option may be selected.

In another example, the step for detecting markers is performed after treating a subject, or during the course of treatment of the subject, (e.g. treatment with the hyaluronan-degrading enzyme (e.g. soluble modified hyaluronidase) (with or without a co-administered agent)), for example, to determine whether the treatment with the hyaluronan degrading enzyme is having an effect on treating the disease or condition. In one such example, the marker is not detected or is detected at an amount or relative level that is decreased compared to the amount/level prior to treatment, or compared to another sample, treatment is continued, another round of treatment is performed, or another treatment, such as a combination therapy, is initiated. In another such example, if the marker is detected at the same level as prior to treatment or another sample, another treatment option may be selected.

i. Assays for Detection of Hyaluronan-Associated Disease Markers

The assays to detect markers of hyaluronan-associated diseases and conditions include assays to measure amount (e.g. relative amount) of hyaluronan and/or hyaluronidase expression in a tissue, cell and/or body fluid of a subject, for example, a tumor. Included amongst such assays are those that can detect HA expression, Hyaluronan synthase 2 (HAS2) expression, the presence of HALOs (pericellular matrix regions that are rich in proteoglycans, including hyaluronan), and the presence of hyaluronan-degrading enzymes, such as hyaluronidases, for example, in samples from the subject.

Assays to detect protein and nucleic acid levels are well known in the art and can be used in the methods herein to measure hyaluronan, hyaluronan synthase or other protein and/or nucleic acid expression. Such assays include, but are not limited to, ELISA, SDS-PAGE, Western Blot, PCR, RT-PCR, immunohistochemistry, histology and flow cytometry. For example, a sample from a subject, such as a tissue sample (e.g. a biopsy of a tumor from a patient or animal model, a stromal sample), a fluid (e.g. blood, urine, plasma, saliva or other sample), a cell or cellular sample, or extract, or other sample, can be stained with anti-HA antibodies, for example, using histological staining, such as immunohistochemistry (IHC) of fixed or frozen tissue sections, to determine the presence and extent of hyaluronan in the tissue or sample (see, e.g. Example 8.B.2.), or immunofluorescent cellular staining, pull-down assays, and flow cytometry. In another example, the sample, e.g. biopsy, can be assayed by RT-PCR to assess the amount of HA mRNA.

Known methods for detection of hyaluronan-expression in cancer include, but are not limited to, the ELISA-like assay described in Lokeshwar et al., *Cancer Res.* 57: 773-777 (1997), for measuring HA levels in urine or bladder tissue extracts of subjects having bladder cancer. For the assay, urine or extracts are coated on microwell plates (umbilical cord HA used as a standard also is coated), followed by incubation (e.g. 16 hours, room temperature) with a labeled (e.g. biotinylated) HA binding protein, such as those described herein, washed and the HA-binding protein bound to the wells quantified using an avidin-biotin detection agent substrate. Such methods are well known in the art. In one example, the urine from a subject with an HA-associated bladder cancer contained HA levels that were elevated 2-9 fold compared to urine/extracts from normal patients (healthy subjects or subjects with other gastrourinary diseases or conditions); thus the marker would be detected if the HA levels in the urine was elevated compared to normal subjects, e.g. elevated from between at or about 2-fold and at or about 9-fold, e.g. at or about 2, 3, 4, 5, 6, 7, 8 or 9-fold elevation compared to normal subject.

In a further example, hyaluronan expression and production in tumor cells in vitro can be assessed using any one of the methods described above. Similarly, Hyaluronan synthase 2 (HAS2) production and/or expression by cells in vitro, ex vivo or in vivo also can be assayed by, for example, ELISA, SDS-PAGE, Western Blot, PCR, RT-PCR, immunohistochemistry, histology or flow cytometry.

In another example, the amount of hyaluronidase activity in a sample from the subject is determined, such as in the blood or plasma, for example, as described in Example 2, such as with a turbidity assay.

In another example, a cell or other tissue from a patient is isolated, e.g. a tumor cell, and used in a study to determine whether the cell or tissue is responsive to treatment with the hyaluronan degrading enzyme in vitro, for example, using a clonogenic assay or any other assay for measuring growth, proliferation and/or survival of cells or tissues, such as tumor cells, in response to treatment. In one example, a study as described in Example 7D, below, by seeding cancer cells from a subject on surface, such as an extracellular matrix or protein mixture, such as the mixture sold under the trade name Matrigel® (BD Biosciences). In this example, the hyaluronan-associated marker is the sensitivity of the cell or tissue to administration of hyaluronan degrading enzyme. In this example, if any property, such as proliferation, growth or survival of the cells, is inhibited or blocked by addition of hyaluronan degrading enzyme, it is determined that the subject may be amenable to treatment with hyaluronan degrading enzyme containing compositions.

In addition to assays for determining hyaluronan expression levels, other assays can be used to select a subject for treatment, and/or to assess treatment efficacy and/or duration. Interstitial fluid pressure (IFP) can be measured using an appropriate probe or instrument. For example, a transducer-tipped catheter can be used to measure the IFP in cancer tissues or other tissues of interest. The catheter is passed through the inner bore of a surgical needle, which is then inserted into the center of the tumor. The needle is withdrawn while the catheter is held in position. The IFP (mmHg) can then be measured using an appropriate data acquisition unit (see e.g. Example 6B, Ozerdem et al. (2005) Microvasc. Res. 70:116-120). Other methods to measure IFP include the wick-in-needle method (Fadnes et al (1977) Microvasc. Res. 14:27-36).

Vascular volume can be measured by, for example, ultrasound imaging, such as described in Example 10, below. This method employs hyper-echoic microbubbles to provide the strong ultrasound wave reflections that are detected. The microbubbles, when injected, such as intravenously, into a subject or animal model, become trapped in the vascular space due to their size. Assays to assess tissue water content, such as tumor tissue water content, also are known in the art. For example, samples from a tumor can be harvested, blotted, weighed and snap frozen before being lyophilized. The water weight is then reported as the tissue wet weight to dry (i.e. lyophilized) weight ratio.

The ability of a tumor cell to form pericellular matrices (halos) in vitro can be assessed using a particle exclusion assay (see e.g. Example 6). Small particles (formalin-fixed red blood cells) can be added to low-density cultures of tumor cells in the presence of, for example, aggrecan, which is a large aggregating chondroitin sulfate proteoglycan. After the particles settle, the cultures can be viewed at 400× magnification to determine whether any halos were formed by the tumor cells. This can are visualized as areas around the cells from which the particles are excluded.

ii. Detection of Hyaluronan-Associated Markers Relative to Control Samples

For any of the detection methods, the marker (e.g. HA expression, responsiveness to hyaluronan degrading enzyme, HA-synthase expression or hyaluronidase activity) typically is compared to a control sample, such that detection of the marker typically includes determining that the readout is elevated or reduced compared to the control sample.

For example, the control sample can be another tissue, cell or body fluid, such as a normal tissue, cell or body fluid, for example, a tissue, cell or body fluid that is analogous to the sample being tested, but isolated from a different subject, such as a subject that is normal (i.e. does not have a disease or condition, or does not have the type of disease or condition that the subject being tested has), for example, a subject that does not have a hyaluronan-associated disease or condition, or an analogous tissue from another subject that has a similar disease or condition, but whose disease is not as severe and/or is not hyaluronan-associated or expresses relatively less hyaluronan and thus is hyaluronan-associated to a lesser degree. For example, when the cell, tissue or fluid being tested is a subject having a cancer, it can be compared to a tissue, cell or fluid from a subject having a less severe cancer, such as an early stage, differentiated or other type of cancer. In another example, control sample is a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines (see, e.g. Example 17A).

It is understood that the particular change, e.g. increase in or decrease in HA, is dependent on the assay used. For example, in an ELISA, the fold increase or decrease in absorbance at a particular wavelength or in quantity of protein (e.g. as determined by using a standard curve) can be expressed relative to a control. In a PCR assay, such as RT-PCR, can be compared to control expression levels (e.g. expressed as fold change) using methods known to those in the art, such as using standards.

For example, when the amount of hyaluronan in a sample from a subject is being tested, detection of the marker can be determining that the amount of HA in the sample (e.g. cancerous cell, tissue or fluid) from the subject is elevated compared to a control sample, such as a control sample described in the previous paragraph. In one example, the cancer is determined to be a hyaluronan-rich cancer if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the control sample, which can be, for example, but not limited to, a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines (see, e.g. Example 17A).

For example, for purposes herein, patients having hyaluronan-rich tumors can be selected for treatment with a hyaluronidase alone or in combination with a second agent. In such examples, the tumor can be directly biopsied and stained for expression of HA. In other examples, a sample, such as a blood or urine sample or other bodily fluid sample associated with the particular tumor can be assayed for HA. The type of assay will vary depending on the tumor-type, although it is contemplated that more than one assay can be used to detect HA. References herein to such assays for particular tumors are for illustration only. For example, for bladder cancers, urine samples can be assayed for hyaluronan by standard ELISA procedures. For purposes herein, subjects that exhibit 1.5-fold, 2-fold, 3-fold, 4-fold, 5-fold, 6-fold, 7-fold, 8-fold, 9-fold, 10-fold or more HA compared to urine from normal patient controls (see e.g., Lokeshwar et al. (2000) J. Urol., 163:348-56), can be selected. In another example, tumor cells can be biopsied and stained for HA, such as by immunohistochemistry (see e.g., Anttila et al. (2000) Cancer Research, 60:150-156; Karvinen et al. (2003) British J of Dermatology, 148:86-94; Lipponen et al. (2001) Euro J Can. 37: 849-856); Auvinen et al. (2000) American J of Pathology, 156:529;). Generally, in such examples, a tumor sample or tumor cell is considered positive for HA if any cancer-cell associated HA signal is observed. As a negative control for background staining, cells can be pre-digested with a hyaluronidase to cleave all cell-associated HA. Samples also can be compared to a normal cell or tissue from the same subject. In addition, in such methods, the level of cell-associated hyaluronan can be scored as low, moderate or high. For example, HA expression is considered high or moderate if 30%, 35%, 40%, 50%, 60%, 70%, 75%, 80%, 85%, 90% or more of the tumoral area showed persistent HA signal. Typically, treatment of subjects with moderate to high HA is contemplated herein.

b. Use in Treating Cancers

As noted above, hyaluronan plays a role in processes associated with cancer and hyaluronan levels correlate with tumor aggressiveness, and various markers for tumor aggressiveness and poor prognosis. Thus, provided are methods for treating hyaluronan-associated cancers with hyaluronan degrading enzymes and compositions and combinations containing hyaluronan degrading enzymes, including hyaluronidases. The cancers include hyaluronan-rich cancers and cancers that are associated with elevated interstitial fluid pressure.

Hyaluronan-associated cancers are cancers associated with hyaluronan-expression, typically elevated hyaluronan expression. In one example, the expression of hyaluronan is elevated in a sample, e.g. a cellular sample, a tissue, tumor stromal, plasma, blood or other sample, from a subject with the cancer, for example, elevated expression compared to a sample from a non-diseased tissue, cell, stroma, plasma, blood, or other sample, or from a less severe cancer, for example, an early stage, differentiated or other type of cancer. The level of hyaluronan can be determined prior to treating the subject, for example, as described above, for example, in Section3(a), above, by histological or other known methods for assessing expression of polypeptide or mRNA.

In one example, the hyaluronan degrading enzyme (e.g. a hyaluronidase) is administered systemically, for example, intravenously (IV), intramuscularly, or by any another systemic route. In another example, the hyaluronan degrading enzyme composition is administered locally, for example, intra-tumorally.

The methods of treatment include repeated administration of the hyaluronan degrading enzyme, for example, administration hourly, every several hours, three times daily, twice daily, once daily, every other day, every third day, every week, every other week, every third week, monthly, or other repeated administration, and also include methods for continuous administration over a period of time.

In one example, treatment of the hyaluronan-associated cancer includes lowering of interstitial fluid pressure in a hyaluronan dependent manner. For example, intravenous administration of a hyaluronan degrading enzyme, such as a hyaluronidase, particularly administration of a modified soluble hyaluronidase (e.g. PEGylated rHuPH20) reduces elevated interstitial fluid pressure in a hyaluronan-rich (PC3) but not a hyaluronan deficient (NCI H460) human carcinoma xenograft model (see Examples 6 and 8-9 below). As shown in the Examples below, interstitial fluid pressure correlates with tumor size in a hyaluronan-rich animal model. Thus, provided herein are methods for treating cancer, e.g. by administering a hyaluronan degrading enzyme, such as a soluble hyaluronidase (e.g. by systemic administration, including intravenous administration), typically a polymer-conjugated hyaluronidase, thereby reducing elevated interstitial fluid pressure, in subjects with hyaluronan associated cancers.

Treatment with the hyaluronan degrading enzyme, such as a hyaluronidase, also can include increasing vascular volume and/or decreasing water content in the tumor, for example, by intravenous administration of the hyaluronidase, In addition to treatment of the disease with the hyaluronan degrading enzyme alone, such as a hyaluronidase alone, the compositions and methods provided herein also can be used to treat hyaluronan-associated cancers by administration of the hyaluronan degrading enzyme in combination with, for example, simultaneously or prior to, a chemotherapeutic or other anti-cancer agent or treatment. In this example, the hyaluronan degrading enzyme, such as a hyaluronidase, typically enhances penetration of chemotherapeutic or other anti-cancer agents into solid tumors, thereby treating the disease. The hyaluronan degrading enzyme, such as a hyaluronidase, can be injected intratumorally with anti-cancer agents or intravenously for disseminated cancers or hard to reach tumors.

Anti-Cancer Agents and Other Treatments

The anticancer agent can be a chemotherapeutic, an antibody, a peptide, or a gene therapy vector, virus or DNA. Additionally, hyaluronan degrading enzymes, such as a hyaluronidase, can be used to recruit tumor cells into the cycling pool for sensitization in previously chemorefractory tumors that have acquired multiple drug resistance (St Croix et al., (1998) Cancer Lett September 131(1): 35-44). Hyaluronan degrading enzymes, including hyaluronidases, such as, for example, rHuPH20, also can enhance delivery of biologics such as monoclonal antibodies, cytokines and other drugs to tumors that accumulate glycosaminoglycans.

Exemplary anti-cancer agents that can be administered after, coincident with or before administration of the hyaluronan degrading enzyme, such as a hyaluronidase, include, but are not limited to Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; Melphalans1L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycins (e.g. BLENOXANE®); Busulfan intravenous (e.g. BUSULFEX®); Busulfan orals (e.g. MYLERAN®); Calusterones (e.g. METHOSARB®); Capecitabines (e.g. XELODA®); Carboplatins (e.g. PARAPLATIN®); Carmustines (e.g. BCNU®, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Dome): Dactinomycins (e.g. COSMEGEN®); Darbepoetin Alfas (e.g. ARANESP®); Daunorubicin liposomals (e.g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Docorubicin HCL liposome injections (e.g. DOXIL®); Dromostanolone propionates (e.g. DROMOSTANOLONE® and MASTER-ONE® Injection); Elliott's B Solutions (e.g. Elliott's B Solution®); Epirubicins (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMASIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2as (e.g. ROFERON-A®); Interferon alfa-2bs (e.g. INTRON A®); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBU®); Meclorethamines/Nitrogen mustards (e.g. MUSTARGEN®); Megestrol acetates (e.g. MEGACE®); Melphalans/L-PAMs (e.g. ALKERAN®); Mercaptopurine, including 6-mercaptopurines (6-MPs; e.g. PURI-NETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g. MITHRACIN®); Porfimer sodiums (e.g. PHOTOFRIN®); Procarbazines (e.g. MATULANE®); Quinacrines (e.g. ATABRINE®); Rasburicases (e.g. ELITEK®); Rituximabs (e.g. RITUXAN®); Sargramostims (e.g. PROKINE®); Streptozocins (e.g. ZANOSAR®); Sunitinib Malates (e.g. SUTENT®); Talcs (e.g. SCLEROSOL®); Tamoxifens (e.g. NOLVADEX®); Temozolomides (e.g. TEMODAR®); Teniposides/VM-26s (e.g. VUMON®); Testolactones (e.g. TESLAC®); Thioguanines including, 6-thioguanine (6-TG); Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards; Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

In one example, a hyaluronan degrading enzyme, such as a modified hyaluronidase, for example, PEGylated rHuPH20, is administered to a subject after, coincident with or before administration of one or more of docetaxel (e.g. TAXOTERE®), Doxorubicin liposomal (e.g. DOXIL®), Sunitinib Malate (e.g. SUTENT®) or Bevacizumab (AVASTIN®).

Hyaluronan degrading enzymes, including hyaluronidases, can also be used to increase the sensitivity of tumors that are resistant to conventional chemotherapy. For example, hyaluronan degrading enzymes, including hyaluronidases, such as rHuPH20, can be administered to a patient having a tumor associated with a HYAL1 defect in an amount effective to increase diffusion around the tumor site (e.g., to facilitate circulation and/or concentrations of chemotherapeutic agents in and around the tumor site), inhibit tumor cell motility, such as by hyaluronic acid degradation, and/or to lower the tumor cell apoptosis threshold. This can bring the tumor cell(s) to a state of anoikis, which renders the tumor cell more susceptible to the action of chemotherapeutic agents. Administration of a hyaluronan degrading enzyme, such as a hyaluronidase, can induce responsiveness of previously chemotherapy-resistant tumors of the pancreas, stomach, colon, ovaries, and breast (Baumgartner et al. (1988) Reg. Cancer Treat. 1:55-58; Zanker et al. (1986) Proc. Amer. Assoc. Cancer Res. 27:390).

In one example, hyaluronan degrading enzymes, in particular, hyaluronidases, are used in the treatment of metastatic and non-metastatic cancers, including those that have decreased endogenous hyaluronidase activity relative to non-cancerous cells. Hyaluronan degrading enzymes such as hyaluronidases can be used as a chemotherapeutic agent alone or in combination with other chemotherapeutics. Exemplary cancers include, but are not limited to, small lung cell carcinoma, squamous lung cell carcinoma, and cancers of the breast, ovaries, head and neck, or any other cancer associated with depressed levels of hyaluronidase activity or decreased hyaluronic acid catabolism.

c. Use in Treating Other Diseases Associated with Elevated Interstitial Fluid Pressure The provided compositions and methods also can be used to treat other hyaluronan-associated diseases associated with high interstitial fluid pressure, including, but not limited to disc pressure and edema, including edema caused by organ transplant, stroke, brain trauma or other conditions described herein.

3. Use as a Spreading Agent

In one example, the hyaluronan degrading enzyme, such as a hyaluronidase, for example rHuPH20 produced using the methods described herein, is administered to treat a hyaluronan-associated disease or condition by promoting or enhancing the delivery of agent(s) and/or molecules to any of a variety of mammalian tissues in vivo. The hyaluronan degrading enzymes, including hyaluronidases can be used to facilitate the diffusion and, therefore, promote the delivery, of small molecule pharmacologic agents as well as larger molecule pharmacologic agents, such as proteins, nucleic acids and ribonucleic acids, and macromolecular compositions that can contain a combination of components including, but not limited to, nucleic acids, proteins, carbohydrates, lipids, lipid-based molecules and drugs. For example, molecules and macromolecular complexes ranging from about 10 nm to about 500 nm in diameter, can exhibit dramatic improvements in delivery through interstitial spaces when the interstitial space has been previously, or is coincidently, exposed to hyaluronidase (see e.g. U.S. patent application Ser. Nos. 10/795,095, 11/065,716 and 11/238,171).

Examples of pharmaceutical, therapeutic, treatment and cosmetic agents, molecules and treatments that can be administered with or following administration of the hyaluronan degrading enzyme, such as a soluble hyaluronidase, include, but are not limited to, anesthetics; antimetabolites, anti-neoplastics, chemotherapeutics, and other anti-cancer agents and anti-cancer treatments; anti-virals; anti-infectives, including anti-bacterials and other antibiotics, anti-fungals and other anti-infectives; immunomodulatory agents; steroidal and non-steroidal anti-inflammatories; beta blockers; sympathomimetics; ducosanoids, prostaglandins and prostaglandin analogs; miotics, cholinergics and anti-cholinesterases; anti-allergenics and decongestants; hormonal agents; growth factors; immunosuppressants; vaccines and toxoids; immune sera; antibodies; analgesic agents, anti-inflammatory agents, antimicrobial agents, amoebicidal agents, trichomonocidal agents, anti-parkinson's disease agents, anti-malarial agents, anticonvulsant agents, anti-depressant agents, antiarthritis agent, anti-fungal agent, antihypertensive agent, antipyretic agent, antiparasitic agent, antihistamine agent, alpha-adrenergic agonist agent, alpha blocker agent, anesthetic agent, bronchial dilator agent, biocide agent, bactericide agent, bacteriostatic agent, beta adrenergic blocker agent, calcium channel blocker agent, cardiovascular drug agent, contraceptive agent, cosmetic or esthetic agent, decongestant agent, diuretic agent, depressant agent, a diagnostic agent, an electrolyte agent, a hypnotic agent, a hormone agent, hyperglycemic agent, muscle relaxant agent, muscle contractant agent, ophthalmic agent, parasympathomimetic agent, psychic energizer agent, sedative agent, sleep inducer, sympathomimetic agent, tranquilizer agent, urinary agent, vaginal agent, viricide agent, vitamin agent, non-steroidal anti-inflammatory agent, and angiotensin converting enzyme inhibitor agent and combinations thereof.

4. Use in Hypodermoclysis

Hypodermoclysis, the infusion of fluids and electrolytes into the hypodermis of the skin, is a useful and simple hydration technique suitable for mildly to moderately dehydrated adult patients, especially the elderly. Although considered safe and effective, the most frequent adverse effect is mild subcutaneous edema that can be treated by local massage or systemic diuretics. Approximately 3 L can be given in a 24-hour period at two separate sites. Common infusion sites include the chest, abdomen, thighs and upper arms. Solutions used in hypodermoclysis include, for example, normal saline, half-normal saline, glucose with saline and 5% glucose. Potassium chloride also can be added to the solution. The addition of one or more hyaluronan degrading enzymes, such as a hyaluronidase, to the solution can enhance fluid absorption and increase the overall rate of administration. Thus, the provided compositions and methods can be used to treat hypodermoclysis by administration to a subject.

5. Application on Vitrectomy and Ophthalmic Disorders and Conditions

The provided compositions containing hyaluronan degrading enzymes, such as soluble hyaluronidases, can be used to minimize the detachment or tearing of the retina during vitrectomy. Such tearing can cause, for example, the vitreous body to become uncoupled or "disinserted" from the retina, prior to removal of the vitreous body. Such disinsertion or uncoupling of the vitreous body can minimize the likelihood that further tearing or detachment of the retina will occur as the vitreous body is removed.

The provided hyaluronan degrading enzyme compositions, including hyaluronidase compositions, and methods can be used for various ophthalmic applications, including the vitrectomy adjunct application described in U.S. Pat. No. 5,292,509. The use of a highly purified hyaluronan degrading enzyme, such as a hyaluronidase, such as, for example, rHuPH20 produced and purified by the methods described herein, is preferable for intraocular procedures to minimize immunogenicity and toxicity. In some examples, a pegylated hyaluronidase can be used to prolong residence within the vitreous and prevent localized uptake.

Hyaluronan degrading enzymes, including hyaluronidases, including the provided compositions containing soluble hyaluronidases, can be used to treat and/or prevent ophthalmic disorders by, for example, preventing neovascularization and increasing the rate of clearance from the vitreous of materials toxic to the retina. Hyaluronan degrading enzymes, including hyaluronidases, can be administered in an amount effective to liquefy the vitreous humor of the eye without causing toxic damage to the eye. Liquefaction of the vitreous humor increases the rate of liquid exchange from the vitreal chamber. This increase in exchange removes the contaminating materials whose presence can cause ophthalmologic and retinal damage.

The provided hyaluronan degrading enzyme compositions, including the hyaluronidase compositions, and methods also can be used to reduce postoperative pressure. Hyaluronic acid has been used in eye primarily as a spacer during cataract and intraocular lens surgical procedures. It also is used in other ocular surgical procedures such as glaucoma, vitreous and retina surgery and in corneal transplantation. A common side effect occurring in postoperative cataract patients is a significant early, and occasionally prolonged, rise in intraocular pressure. Such a condition is sometimes serious, especially in patients with glaucomatous optic disc changes. Hyaluronan degrading enzymes such as hyaluronidases can be co-administered with hyaluronic acid to the eye prior to surgery to reduce postoperative pressure in the eye. For example, a hyaluronidase can be administered in an amount effective to reduce the intraocular pressure to pre-operative levels by breaking down the hyaluronic acid without decreasing its effectiveness during surgery nor causing side effects in the patient (U.S. Pat. No. 6,745,776).

Hyaluronan degrading enzymes such as hyaluronidases also can be administered to patients with glaucoma to remove glycosaminoglycans from the orbicular meshwork and reduce intraocular pressure, and can be applied to the vitreous to promote the resolution of vitreous hemorrhages (i.e. extravasations of blood into the vitreous), which can occur in connection with conditions such as diabetic retinopathy, retinal neovascularization, retinal vein occlusion, posterior vitreous detachment, retinal tears and ocular traumas. The presence of vitreous hemorrhages, which are typically slow to resolve, can delay, complicate or prevent procedures that require the retina to be visualized through the vitreous for diagnosis and/or for treatment procedures, such as, but are not limited to, laser photocoagulation, which are often primary treatments for conditions such as proliferative diabetic retinopathy.

6. Gene Therapy Applications

The efficacy of most gene delivery vehicles in vivo does not correspond to the efficacy found observed in vitro. Glycosaminoglycans can hinder the transfer and diffusion of DNA and viral vectors into many cell types. The levels such extracellular matrix material can hinder the process considerably. Administration of hyaluronan degrading enzymes such as hyaluronidases can open channels in the extracellular matrix, thus enhancing delivery of gene therapy. For example, a hyaluronan degrading enzyme such as a hyaluronidase can be administered with collagenase to facilitate transduction of DNA in vivo (Dubinsky et al. (1984) Proc Natl Acad Sci USA 81(23):7529-33). Hyaluronan degrading enzymes, including hyaluronidases, also can enhance gene therapy using adeno-associated virus (Favre et al, (2000) Gene Therapy 7(16):1417-20). The channels opened following administration of, for example, hyaluronidase, are of a size that typically enhance diffusion of smaller molecules such as retroviruses, adenoviruses, adeno-associated viruses and DNA complexes (as well as other therapeutic and pharmacological agents of interest). The pores are not so large, however, as to promote the dislocation and movement of cells.

In some examples, viruses can be engineered to express one or more hyaluronan degrading enzymes, such as a hyaluronidase, to facilitate their replication and spread within a target tissue. The target tissue can be, for example, a cancerous tissue whereby the virus is capable of selective replication within the tumor. The virus also can be a non-lytic virus wherein the virus selectively replicates under a tissue specific promoter. As the viruses replicate, the co-expression of the hyaluronan degrading enzyme, such as a hyaluronidase, with viral genes can facilitate the spread of the virus in vivo.

7. Cosmetic Applications

Hyaluronan degrading enzymes, including hyaluronidases, can be administered to remove glycosaminoglycans involved in the accumulation of cellulite and to promote lymphatic flow. In some examples, hyaluronan degrading enzymes, including human hyaluronidases, such as for example, rHuPH20, are used for the treatment of cellulite. The hyaluronan degrading enzyme, such as a hyaluronidase, can be administered through repeated subcutaneous injections, through transdermal delivery in the form of ointments or creams or through the use of injectable slow release formulations to promote the continual degradation of glycosaminoglycans and prevent their return.

Hyaluronan degrading enzymes, including hyaluronidases also, can be used to treat conditions such as "pigskin" edema or "orange peel" edema. Hyaluronan degrading enzymes such as hyaluronidases can effect depolymerization of the long mucopolysaccharide chains that can accumulate in the dermis and which are responsible for the retention of bound water and of the slowing, by capillary compression, of the diffusion of organic liquids, which eliminate metabolic wastes. Such retention of water and wastes associated with fat overloading of the lipocytes, constitutes classical "pigskin" edema or "orange peel" edema. Depolymerization can cut the long chains of mucopolysaccharides into shorter chains, resulting in the elimination of the bound water and wastes and restoration of the venous and lymphatic circulation, culminating in the disappearance of local edema.

8. Use in Organ Transplantation

The content of hyaluronic acid in an organ can increase with inflammation. An increased concentration of hyaluronic acid has been observed in tissue from different organs characterized by inflammatory-immunological injury such as alveolitis (Nettelbladt et al. (1991) Am. Rev. Resp. Dis. 139: 759-762) and myocardial infarction (Waldenstrom et al. (1991) J. Clin. Invest. 88(5): 1622-1628). Other examples include allograft rejection after a renal (Haellgren et al. (1990) J. Exp. Med. 171: 2063-2076; Wells et al. (1990) Transplantation 50: 240-243), small bowel (Wallander et al. (1993) Transplant. Int. 6: 133-137) or cardiac (Haellgren et al. (1990) J Clin Invest 185:668-673) transplantation; or a myocardial inflammation of viral origin (Waldenstrom et al. (1993) Eur. J. Clin. Invest. 23: 277-282). The occurrence of interstitial edemas in connection with the grafting of an organ constitutes a severe problem in the field of transplantation surgery. Grafts with interstitial edemas can swell to such a degree that the function is temporarily lost. In some instances, the swelling can cause disruption of the kidney, resulting in a massive hemorrhage. Hyaluronan degrading enzymes, including hyaluronidases can be used to degrade accumulated glycosaminoglycans in an organ transplant. Removal of such glycosaminoglycans promotes removal of water from the graft and thus enhances organ function.

9. Use in Treatment of Glycosaminoglycan Accumulation in the Brain

Hyaluronic acid levels are elevated in a number of cerebrospinal pathologic conditions. Levels of cerebrospinal hyaluronic acid are normally less than 200 µg/L in adults (Laurent et al. (1996) Acta Neurol Scand September 94(3): 194-206), but can elevate to levels of over 8000 µg/L in diseases such as meningitis, spinal stenosis, head injury and cerebral infarction. Hyaluronan degrading enzymes, including hyaluronidases, such as, for example, rHuPH20, can be utilized to degrade critically elevated levels of substrate.

The lack of effective lymphatics in the brain also can lead to life threatening edema following head trauma. Hyaluronic acid accumulation is a result of increased synthesis by hyaluronic acid synthases and decreased degradation. Accumulation of hyaluronic acid can initially serve the beneficial purpose of increasing water content in the damaged tissue to facilitate leukocyte extravasation, but continued accumulation can be lethal. Administration of a hyaluronan degrading enzyme, such as a hyaluronidase, such as intrathecally or intravenously, to a patient suffering from head trauma can serve to remove tissue hyaluronic acid accumulation and the water associated with it.

Hyaluronan degrading enzymes such as hyaluronidases also can be used in the treatment of edema associated with brain tumors, particularly that associated with glioblastoma multiform. The edema associated with brain tumors results from the accumulation of hyaluronic acid in the non-cancerous portions of the brain adjacent the tumor. Administration of a hyaluronan degrading enzyme, such as a hyaluronidase, to the sites of hyaluronic acid accumulation (e.g., by intravenous injection or via a shunt) can relieve the edema associated with such malignancies by degrading the excess hyaluronic acid at these sites.

10. Use in Treatment of Glycosaminoglycan Accumulation in Cardiovascular Disease Hyaluronan degrading enzymes, including hyaluronidases, can be used in the treatment of some cardiovascular disease. Administration of a hyaluronan degrading enzyme, such as a hyaluronidase, in animal models following experimental myocardial infarct can reduce infarct size (Maclean, et al (1976) Science 194(4261):199-200). One proposed mechanism by which this can occur is by reducing hyaluronic acid accumulation that occurs following ischemia reperfusion. Reduction of infarct size is believed to occur from increased lymph drainage and increased tissue oxygenation and reduction of myocardial water content.

Hyaluronan degrading enzymes, including hyaluronidases, also can be used to limit coronary plaques from arteriosclerosis. Such plaques accumulate glycosaminoglycans and mediate macrophage and foam cell adhesion (Kolodgie et al. (2002) Arterioscler Thromb Vasc Biol. 22(10):1642-8).

11. Use in Pulmonary Disease

Levels of hyaluronic acid in broncheoalveolar lavages (BAL) from normal individuals are generally below 15 ng/ml. However, hyaluronic acid levels in BAL rise dramatically in conditions of respiratory distress (Bjermer et al. (1987) Br Med J (Clin Res Ed) 295(6602):803-6). The increased hyaluronic acid in the lung can prevent oxygen diffusion and gas exchange as well as activating neutrophil and macrophage responses. Purified preparations of hyaluronan degrading enzymes, such as, for example, rHuPH20, such as those produced using the methods provided herein, can be delivered by either pulmonary or intravenous delivery to patients presenting with such conditions to reduce hyaluronan levels. Hyaluronan degrading enzymes, including hyaluronidases, also can be administered to patients suffering from other pulmonary complications that are associated with elevated glycosaminoglycans or to enhance the delivery of other co-delivered molecules to the lung.

12. Other Uses

In further examples of its therapeutic use, hyaluronan degrading enzymes such as hyaluronidases can be used for such purposes as an antidote to local necrosis from paravenous injection of necrotic substances such as vinka alkaloids (Few et al. (1987) Amer. J. Matern. Child Nurs. 12, 23-26), treatment of ganglion cysts (Paul et al. (1997) J Hand Surg. 22 (2): 219-21) and treatment of tissue necrosis due to venous insufficiency (Elder et al. (1980) Lancet 648-649). Hyaluronan degrading enzymes, including hyaluronidases, also can be used to treat ganglion cysts (also known as a wrist cyst, Bible cyst, or dorsal tendon cyst), which are the most common soft tissue mass of the hand and are fluid filled sacs that can be felt below the skin.

Hyaluronan degrading enzymes such as hyaluronidases can be used in the treatment of spinal cord injury by degrading chondroitin sulfate proteoglycans (CSPGs). Following spinal cord injury, glial scars containing CSPGs are produced by astrocytes. CSPGs play a crucial role in the inhibition of axon growth. In addition, the expression of CSPG has been shown to increase following injury of the central nervous system (CNS). Hyaluronan degrading enzymes also can be utilized for the treatment of herniated disks in a process known as chemonucleolysis. Chondroitinase ABC, an enzyme cleaving similar substrates as hyaluronidase, can induce the reduction of intradiscal pressure in the lumbar spine. There are three types of disk injuries. A protruded disk is one that is intact but bulging. In an extruded disk, the fibrous wrapper has torn and the nucleus pulposus (NP) has oozed out, but is still connected to the disk. In a sequestered disk, a fragment of the NP has broken loose from the disk and is free in the spinal canal. Chemonucleolysis is typically effective on protruded and extruded disks, but not on sequestered disk injuries.

I. EXAMPLES

The following examples are included for illustrative purposes only and are not intended to limit the scope of the invention.

Example 1

Generation of a Soluble rHuPH20-Expressing Cell Line

The HZ24 plasmid (set forth in SEQ ID NO:52) was used to transfect Chinese Hamster Ovary (CHO cells) (see e.g. application Ser. Nos. 10/795,095, 11/065,716 and 11/238,171). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1), followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:3) and amino acids 1-186 of mouse dihydrofolate reductase (set forth in SEQ ID NO:53), separated by the internal ribosomal entry site (IRES).

Non-transfected DG44 CHO cells growing in GIBCO Modified CD-CHO media for DHFR(-) cells, supplemented with 4 mM Glutamine and 18 ml/L Plurionic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2 \times 10^7$ cells in 0.7 mL of 2× transfection buffer (2× HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(-) cells, supplemented with 4 mM Glutamine and 18 ml/L Plurionic F68/L (Gibco), and allowed to grow in a well of a E-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity, using the microturbidity assay described in Example 2.

TABLE 3

Initial Hyaluronidase Activity of
HZ24 Transfected DG44 CHO cells at 40 hours
post-transfection

|  | Dilution | Activity Units/ml |
|---|---|---|
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate.

TABLE 4

Hyaluronidase activity of identified clones

| Plate/Well ID | Relative Hyaluronidase |
|---|---|
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment. Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate giving rise to clones producing in excess of 1,000 Units/ml in shaker flasks (clone 3D35M; or Gen1 3D35M). A master cell bank (MCB) of the 3D35M cells was then prepared.

Example 2

Determination of Hyaluronidase Activity of Soluble rHuPH20

Hyaluronidase activity of soluble rHuPH20 in samples such as cell cultures, purification fractions and purified solutions was determined using a turbidimetric assay, which based on the formation of an insoluble precipitate when hyaluronic acid binds with serum albumin. The activity is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve. Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of SWFI, and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not be less than 20 µL. The minimum sample volumes needed to perform the assay were: In-process Samples, FPLC Fractions: 80 µL; Tissue Culture Supernatants: 1 mL; Concentrated Material 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the plate to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384 and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

Example 3

Production and Purification of Gen1 Human sPH20

A. 5 L Bioreactor Process

A vial of 3D35M was thawed and expanded from shaker flasks through 1 L spinner flasks in CD-CHO media (Invitrogen, Carlsbad Calif.) supplemented with 100 nM Methotrexate and GlutaMAX™-1 (Invitrogen). Cells were transferred from spinner flasks to a 5 L bioreactor (Braun) at an inoculation density of $4 \times 10^5$ viable cells per ml. Parameters were temperature setpoint 37° C., pH 7.2 (starting setpoint), with Dissolved Oxygen setpoint 25% and an air overlay of 0-100 cc/min. At 168 hrs, 250 ml of Feed #1 Medium (CD CHO with 50 g/L Glucose) was added. At 216 hours, 250 ml of Feed #2 Medium (CD CHO with 50 g/L Glucose and 10 mM Sodium Butyrate) was added, and at 264 hours 250 ml of Feed #2 Medium was added. This process resulted in a final productivity of 1600 Units per ml with a maximal cell density of $6 \times 10^6$ cells/ml. The addition of sodium butyrate was to dramatically enhance the production of soluble rHuPH20 in the final stages of production.

Conditioned media from the 3D35M clone was clarified by depth filtration and tangential flow diafiltration into 10 mM Hepes pH 7.0. Soluble rHuPH20 was then purified by sequential chromatography on Q Sepharose (Pharmacia) ion exchange, Phenyl Sepharose (Pharmacia) hydrophobic interaction chromatography, phenyl boronate (Prometics) and Hydroxapatite Chromatography (Biorad, Richmond, Calif.).

Soluble rHuPH20 bound to Q Sepharose and eluted at 400 mM NaCl in the same buffer. The eluate was diluted with 2M ammonium sulfate to a final concentration of 500 mM ammonium sulfate and passed through a Phenyl Sepharose (low sub) column, followed by binding under the same conditions to a phenyl boronate resin. The soluble rHuPH20 was eluted from the phenyl sepharose resin in Hepes pH 6.9 after washing at pH 9.0 in 50 mM bicine without ammonium sulfate. The eluate was loaded onto a ceramic hydroxyapatite resin at pH 6.9 in 5 mM potassium phosphate and 1 mM $CaCl_2$ and eluted with 80 mM potassium phosphate, pH 7.4 with 0.1 mM $CaCl_2$.

The resultant purified soluble rHuPH20 possessed a specific activity in excess of 65,000 USP Units/mg protein by way of the microturbidity assay (Example 2) using the USP reference standard. In one example, the specific activity of the native rHuPH20 was around 120,000 Units/mg, while PEGylated rHuPH20 (as described in Example 7, below) has a specific activity of about 30,000 Units/mg. Purified sPH20 eluted as a single peak from 24 to 26 minutes from a Pharmacia 5RPC styrene divinylbenzene column with a gradient between 0.1% $TFA/H_2O$ and 0.1% TFA/90% acetonitrile/10% $H_2O$ and resolved as a single broad 61 kDa band by SDS electrophoresis that reduced to a sharp 51 kDa band upon treatment with PNGASE-F. N-terminal amino acid sequencing revealed that the leader peptide had been efficiently removed.

B. Upstream Cell Culture Expansion Process into 100 L Bioreactor Cell Culture

A scaled-up process was used to separately purify soluble rHuPH20 from four different vials of 3D35M cell to produce 4 separate batches of sHuPH20; HUA0406C, HUA0410C, HUA0415C and HUA0420C. Each vial was separately expanded and cultured through a 125 L bioreactor, then purified using column chromatography. Samples were taken throughout the process to assess such parameters as enzyme yield. The description of the process provided below sets forth representative specifications for such things as bioreactor starting and feed media volumes, transfer cell densities, and wash and elution volumes. The exact numbers vary slightly with each batch, and are detailed in Tables 10 to 11.

Four vials of 3D35M cells were thawed in a 37° C. water bath, CD CHO containing 100 nM methotrexate and 40 mL/L GLutaMAX was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached $1.5$-$2.5 \times 10^6$ cells/mL, the culture was expanded into a 125 mL spinner flask in a 100 mL culture volume. The flask was incubated at 37° C., 7% $CO_2$. When the cell density reached $1.5$-$2.5 \times 10^6$ cells/mL, the culture was expanded into a 250 mL spinner flask in 200 mL culture volume, and the flask was incubated at 37° C., 7% $CO_2$. When the cell density reached $1.5$-$2.5 \times 10^6$ cells/mL, the culture was expanded into a 1 L spinner flask in 800 mL culture volume and incubated at 37° C., 7% $CO_2$. When the cell density reached $1.5$-$2.5 \times 10^6$ cells/mL, the culture was expanded into a 6 L spinner flask in 5 L culture volume and incubated at 37° C., 7% $CO_2$. When the cell density reached $1.5$-$2.5 \times 10^6$ cells/mL, the culture was expanded into a 36 L spinner flask in 20 L culture volume and incubated at 37° C., 7% $CO_2$.

A 125 L reactor was sterilized with steam at 121° C., 20 PSI and 65 L of CD CHO media was added. Before use, the reactor was checked for contamination. When the cell density in the 36 L spinner flasks reached $1.8$-$2.5 \times 10^6$ cells/mL, 20 L cell culture were transferred from the 36 L spinner flasks to the 125 L bioreactor (Braun), resulting a final volume of 85 L and a seeding density of approximately $4 \times 10^5$ cells/mL. Parameters were temperature set point, 37° C.; pH: 7.2; Dissolved oxygen: 25%±10%; Impeller Speed 50 rpm; Vessel Pressure 3 psi; Air Sparge 1 L/min.; Air Overlay: 1 L/min. The reactor was sampled daily for cell counts, pH verification, media analysis, protein production and retention. Nutrient feeds were added during the run. At Day 6, 3.4 L of Feed #1 Medium (CD CHO+50 g/L Glucose+40 mL/L GlutaMAX™-1) was added, and culture temperature was changed to 36.5° C. At day 9, 3.5 L of Feed #2 (CD CHO+50 g/L Glucose+40 mL/L GlutaMAX™-1+ 1.1 g/L Sodium Butyrate) was added, and culture temperature was changed to 36° C. At day 11, 3.7 L of Feed #3 (CD CHO+50 g/L Glucose+40 mL/L GlutaMAX™-1+1.1 g/L Sodium Butyrate) was added, and the culture temperature was changed to 35.5° C. The reactor was harvested at 14 days or when the viability of the cells dropped below 50%. The process resulted in production of soluble rHuPH20 with an enzymatic activity of 1600 Units/ml with a maximal cell density of 8 million cells/mL. At harvest, the culture was sampled for mycoplasma, bioburden, endotoxin, and virus in vitro and in vivo, transmission electron microscopy (TEM) for viral particles, and enzyme activity.

The one hundred liter bioreactor cell culture harvest was filtered through a series of disposable capsule filters having a polyethersulfone medium (Sartorius): first through a 8.0 μm depth capsule, a 0.65 μm depth capsule, a 0.22 μm capsule, and finally through a 0.22 μm Sartopore 2000 $cm^2$ filter and into a 100 L sterile storage bag. The culture was concentrated 10× using two TFF with Spiral Polyethersulfone 30 kDa MWCO filters (Millipore), followed by a 6× buffer exchange with 10 mM HEPES, 25 mM $Na_2SO_4$, pH 7.0 into a 0.22 μm final filter into a 20 L sterile storage bag. Table 5 provides monitoring data related to the cell culture, harvest, concentration and buffer exchange steps.

TABLE 5

Monitoring data for cell culture, harvest, concentration and buffer exchange steps.

| Parameter | HUA0406C | HUA04010C | HUA0415C | HUA0420C |
|---|---|---|---|---|
| Time from thaw to inoculate 100 L bioreactor (days) | 21 | 19 | 17 | 18 |
| 100 L inoculation density ($\times 10^6$ cells/mL) | 0.45 | 0.33 | 0.44 | 0.46 |
| Doubling time in logarithmic growth (hr) | 29.8 | 27.3 | 29.2 | 23.5 |
| Max. cell density ($\times 10^6$ cells/mL) | 5.65 | 8.70 | 6.07 | 9.70 |
| Harvest viability (%) | 41 | 48 | 41 | 41 |
| Harvest titer (U/ml) | 1964 | 1670 | 991 | 1319 |
| Time in 100-L bioreactor (days) | 13 | 13 | 12 | 13 |
| Clarified harvest volume (mL) | 81800 | 93300 | 91800 | 89100 |
| Clarified harvest enzyme assay (U/mL) | 2385 | 1768 | 1039 | 1425 |
| Concentrate enzyme assay (U/mL) | 22954 | 17091 | 8561 | 17785 |
| Buffer exchanged concentrate enzyme assay (U/mL) | 15829 | 11649 | 9915 | 8679 |
| Filtered buffer exchanged concentrate enzyme assay (U/mL) | 21550 | 10882 | 9471 | 8527 |
| Buffer exchanged concentrate volume (mL) | 10699 | 13578 | 12727 | 20500 |
| Ratio enzyme units concentration/harvest | 0.87 | 0.96 | 1.32 | 1.4 |

A Q Sepharose (Pharmacia) ion exchange column (3 L resin, Height=20 cm, Diameter=14 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. The concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM Hepes, 50 mM NaCl, pH 7.0. The protein was eluted with 10 mM Hepes, 400 mM NaCl, pH 7.0 and filtered through a 0.22 μm final filter into a sterile bag.

Phenyl-Sepharose (Pharmacia) hydrophobic interaction chromatography was performed next. A Phenyl-Sepharose (PS) column (9.1 L resin, Height=29 cm, Diameter=20 cm) was prepared. The column was equilibrated with 5 column volumes of 5 mM potassium phosphate, 0.5 M ammonium sulfate, 0.1 mM $CaCl_2$, pH 7.0. The protein eluate from above was supplemented with 2M ammonium sulfate, 1 M potassium phosphate and 1 M $CaCl_2$ stock solutions to final concentrations of 5 mM, 0.5 M and 0.1 mM, respectively. The protein was loaded onto the PS column at a flow rate of 100 cm/hr. 5 mM potassium phosphate, 0.5 M ammonium sulfate and 0.1 mM $CaCl_2$ pH 7.0 was added at 100 cm/hr. The flow through was passed through a 0.22 μm final filter into a sterile bag.

The PS-purified protein was then loaded onto an aminophenyl boronate column (ProMedics) (6.3 L resin, Height=20 cm, Diameter=20 cm) that had been equilibrated with 5 column volumes of 5 mM potassium phosphate, 0.5 M ammonium sulfate. The protein was passed through the column at a flow rate of 100 cm/hr, and the column was washed with 5 mM potassium phosphate, 0.5 M ammonium sulfate, pH 7.0. The column was then washed with 20 mM bicine, 100 mM NaCl, pH 9.0 and the protein eluted with 50 mM Hepes, 100 mM NaCl pH 6.9 through a sterile filter and into a 20 L sterile bag. The eluate was tested for bioburden, protein concentration and enzyme activity.

A hydroxyapatite (HAP) column (BioRad) (1.6 L resin, Height=10 cm, Diameter=14 cm) was equilibrated with 5 mM potassium phosphate, 100 mM NaCl, 0.1 mM $CaCl_2$ pH 7.0. Wash samples were collected and tested for pH, conductivity and endotoxin (LAL) assay. The aminophenyl boronate purified protein was supplemented with potassium phosphate and $CaCl_2$ to yield final concentrations of 5 mM potassium phosphate and 0.1 mM $CaCl_2$ and loaded onto the HAP column at a flow rate of 100 cm/hr. The column was washed with 5 mM potassium phosphate pH 7.0, 100 mM NaCl, 0.1 mM $CaCl_2$, then 10 mM potassium phosphate pH 7.0, 100 mM NaCl, 0.1 mM $CaCl_2$ pH. The protein was eluted with 70 mM potassium phosphate pH 7.0 and filtered through a 0.22 m filter into a 5 L sterile storage bag. The eluate was tested for bioburden, protein concentration and enzyme activity.

The HAP-purified protein was then pumped through a 20 nm viral removal filter via a pressure tank. The protein was added to the DV20 pressure tank and filter (Pall Corporation), passing through an Ultipor DV20 Filter with 20 nm pores (Pall Corporation) into a sterile 20 L storage bag. The filtrate was tested for protein concentration, enzyme activity, oligosaccharide, monosaccharide and sialic acid profiling, and process-related impurities. The protein in the filtrate was then concentrated to 1 mg/mL using a 10 kD molecular weight cut off (MWCO) Sartocon Slice tangential flow filtration (TFF) system (Sartorius). The filter was first prepared by washing with a Hepes/saline solution (10 mM Hepes, 130 mM NaCl, pH 7.0) and the permeate was sampled for pH and conductivity. Following concentration, the concentrated protein was sampled and tested for protein concentration and enzyme activity. A 6× buffer exchange was performed on the concentrated protein into the final buffer: 10 mM Hepes, 130 mM NaCl, pH 7.0. The concentrated protein was passed though a 0.22 μm filter into a 20 L sterile storage bag. The protein was sampled and tested for protein concentration, enzyme activity, free sulfhydryl groups, oligosaccharide profiling and osmolarity.

Tables 5 to 11 provide monitoring data related to each of the purification steps described above, for each 3D35M cell lot.

TABLE 6

Q sepharose column data

| Parameter | HUA0406C | HUA0410C | HUA0415C | HUA0420C |
|---|---|---|---|---|
| Load volume (mL) | 10647 | 13524 | 12852 | 20418 |
| Load Volume/Resin Volume ratio | 3.1 | 4.9 | 4.5 | 7.3 |
| Column Volume (mL) | 2770 | 3840 | 2850 | 2880 |
| Eluate volume (mL) | 6108 | 5923 | 5759 | 6284 |
| Protein Conc. of Eluate (mg/mL) | 2.8 | 3.05 | 2.80 | 2.86 |
| Eluate Enzyme Assay (U/mL) | 24493 | 26683 | 18321 | 21052 |
| Enzyme Yield (%) | 65 | 107 | 87 | 76 |

TABLE 7

Phenyl Sepharose column data

| Parameter | HUA0406C | HUA0410C | HUA0415C | HUA0420C |
|---|---|---|---|---|
| Volume Before Stock Solution Addition (mL) | 5670 | 5015 | 5694 | 6251 |
| Load Volume (mL) | 7599 | 6693 | 7631 | 8360 |
| Column Volume (mL) | 9106 | 9420 | 9340 | 9420 |
| Load Volume/Resin Volume ratio | 0.8 | 0.71 | 0.82 | 0.89 |
| Eluate volume (mL) | 16144 | 18010 | 16960 | 17328 |
| Protein Conc of Eluate (mg/mL) | 0.4 | 0.33 | 0.33 | 0.38 |
| Eluate Enzyme Assay (U/mL) | 8806 | 6585 | 4472 | 7509 |
| Protein Yield (%) | 41 | 40 | 36 | 37 |
| Enzyme Yield (%) | 102 | 88 | 82 | 96 |

TABLE 8

Amino Phenyl Boronate column data

| Parameter | HUA0406C | HUA0410C | HUA0415C | HUA0420C |
|---|---|---|---|---|
| Load Volume (mL) | 16136 | 17958 | 16931 | 17884 |
| Load Volume/Resin Volume ratio | 2.99 | 3.15 | 3.08 | 2.98 |
| Column Volume (mL) | 5400 | 5700 | 5500 | 5300 |
| Eluate volume (mL) | 17595 | 22084 | 20686 | 19145 |
| Protein Conc. of Eluate (mg/mL) | 0.0 | 0.03 | 0.03 | 0.04 |
| Protein Conc. of Filtered Eluate (mg/mL) | not tested | 0.03 | 0.00 | 0.04 |
| Eluate Enzyme Assay (U/mL) | 4050 | 2410 | 1523 | 4721 |
| Protein Yield (%) | 0 | 11 | 11 | 12 |
| Enzyme Yield (%) | not determined | 41 | 40 | 69 |

TABLE 9

Hydroxyapatite column data

| Parameter | HUA0406C | HUA0410C | HUA0415C | HUA0420C |
|---|---|---|---|---|
| Volume Before Stock Solution Addition (mL) | 16345 | 20799 | 20640 | 19103 |
| Load Volume/Resin Volume ratio | 10.95 | 13.58 | 14.19 | 12.81 |
| Column Volume (mL) | 1500 | 1540 | 1462 | 1500 |
| Load volume (mL) | 16429 | 20917 | 20746 | 19213 |
| Eluate volume (mL) | 4100 | 2415 | 1936 | 2419 |
| Protein Conc. of Eluate (mg/mL) | not tested | 0.24 | 0.17 | 0.23 |
| Protein Conc. of Filtered Eluate (mg/mL) | NA | NA | 0.17 | NA |
| Eluate Enzyme Assay (U/mL) | 14051 | 29089 | 20424 | 29826 |
| Protein Yield (%) | Not tested | 93 | 53 | 73 |
| Enzyme Yield (%) | 87 | 118 | 140 | 104 |

TABLE 10

DV20 filtration data

| Parameter | HUA0406C | HUA0410C | HUA0415C | HUA0420C |
|---|---|---|---|---|
| Start volume (mL) | 4077 | 2233 | 1917 | 2419 |
| Filtrate Volume (mL) | 4602 | 3334 | 2963 | 3504 |
| Protein Conc. of Filtrate (mg/mL) | 0.1 | NA | 0.09 | NA |
| Protein Conc. of Filtered Eluate (mg/mL) | NA | 0.15 | 0.09 | 0.16 |
| Protein Yield (%) | not tested | 93 | 82 | 101 |

TABLE 11

Final concentration data

| Parameter | HUA0406C | HUA0410C | HUA0415C | HUA0420C |
|---|---|---|---|---|
| Start volume (mL) | 4575 | 3298 | 2963 | 3492 |
| Concentrate Volume (mL) | 562 | 407 | 237 | 316 |

TABLE 11-continued

Final concentration data

| Parameter | HUA0406C | HUA0410C | HUA0415C | HUA0420C |
|---|---|---|---|---|
| Protein Conc. of Concentrate (mg/mL) | 0.9 | 1.24 | 1.16 | 1.73 |
| Protein Yield (%) | 111 | 102 | 103 | 98 |

TABLE 12

Buffer Exchange into Final Formulation data

| Parameter | HUA0406C | HUA0410C | HUA0415C | HUA0420C |
|---|---|---|---|---|
| Start Volume (mL) | 562 | 407 | 237 | 316 |
| Final Volume Buffer Exchanged Concentrate (mL) | 594 | 516 | 310 | 554 |
| Protein Conc. of Concentrate (mg/mL) | 1.00 | 0.97 | 0.98 | 1.00 |
| Protein Conc. of Filtered Concentrate (mg/mL) | 0.95 | 0.92 | 0.95 | 1.02 |
| Protein Yield (%) | 118 | 99 | 110 | 101 |

The purified and concentrated soluble rHuPH20 protein was aseptically filled into sterile vials with 5 mL and 1 mL fill volumes. The protein was passed though a 0.22 µm filter to an operator controlled pump that was used to fill the vials using a gravimetric readout. The vials were closed with stoppers and secured with crimped caps. The closed vials were visually inspected for foreign particles and then labeled. Following labeling, the vials were flash-frozen by submersion in liquid nitrogen for no longer than 1 minute and stored at ≤−15° C. (−20±5° C.).

Example 4

Production Gen2 Cells Containing Soluble Human PH20 (rHuPH20)

The Gen1 3D35M cell line described in Example 1 was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the 12$^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the 8$^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr−) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:47) except for one base pair difference at position 1131, which was observed to be a thymidine (T) instead of the expected cytosine (C). This is a silent mutation, with no effect on the amino acid sequence.

Example 5

A. Production of Gen2 Soluble rHuPH20 in 300 L Bioreactor Cell Culture

A vial of HZ24-2B2 was thawed and expanded from shaker flasks through 36L spinner flasks in CD-CHO media (Invitrogen, Carlsbad, Calif.) supplemented with 20 µM methotrexate and GlutaMAX-1™ (Invitrogen). Briefly, a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than 1.5×10$^6$ cells/mL, the culture was expanded into a 125 mL spinner flask in a 100 mL culture volume. The flask was incubated at 37° C., 7% $CO_2$. When the cell density reached greater than 1.5×10$^6$ cells/mL, the culture was expanded into a 250 mL spinner flask in 200 mL culture volume, and the flask was incubated at 37° C., 7% $CO_2$. When the cell density reached greater than 1.5×10$^6$ cells/mL, the culture was expanded into a 1 L spinner flask in 800 mL culture volume and incubated at 37° C., 7% $CO_2$. When the cell density reached greater than 1.5×10$^6$ cells/mL the culture was expanded into a 6 L spinner flask in 5000 mL culture volume and incubated at 37° C., 7% $CO_2$. When the cell density reached greater than 1.5×106 cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of 4.0×10$^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+ 160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+ 167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+ 1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μM final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorius), followed by a 10× buffer exchange with 10 mM Tris, 20 mM Na$_2$SO$_4$, pH 7.5 into a 0.22 μm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM Na2SO4, pH 7.5. Following viral inactivation, the concentrated, diafiltered harvest was loaded onto the Q column at a flow rate of 100 cm/hr. The column was washed with 5 column volumes of 10 mM Tris, 20 mM Na2SO4, pH 7.5 and 10 mM Hepes, 50 mM NaCl, pH 7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance reading were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM CaCl2, pH 7.0. The protein eluate from the Q sepharose column was supplemented with 2M ammonium sulfate, 1 M potassium phosphate and 1 M CaCl$_2$ stock solutions to yield final concentrations of 5 mM, 0.5 M and 0.1 mM, respectively. The protein was loaded onto the PS column at a flow rate of 100 cm/hr and the column flow through collected. The column was washed with 5 mM potassium phosphate, 0.5 M ammonium sulfate and 0.1 mM CaCl2 pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and test for pH, conductivity and endotoxin (LAL assay). The column was equilibrated with 5 mM potassium phosphate, 100 mM NaCl, 0.1 mM CaCl$_2$, pH 7.0. The aminophenyl boronate purified protein was supplemented to final concentrations of 5 mM potassium phosphate and 0.1 mM CaCl$_2$ and loaded onto the HAP column at a flow rate of 100 cm/hr. The column was washed with 5 mM potassium phosphate, pH 7, 100 mM NaCl, 0.1 mM CaCl$_2$. The column was next washed with 10 mM potassium phosphate, pH 7, 100 mM NaCl, 0.1 mM CaCl$_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nm viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kD molecular weight cut off (MWCO)

Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed through a 0.22 μm filter into a 20 L sterile storage bag. The protein was sampled and tested for protein concentration, enzyme activity, free sulfhydryl groups, oligosaccharide profiling and osmolarity.

The sterile filtered bulk protein was then aseptically dispensed at 20 mL into 30 mL sterile Teflon vials (Nalgene). The vials were then flash frozen and stored at −20±5° C.

C. Comparison of Production and Purification of Gen1 Soluble rHuPH20 and Gen2 Soluble rHuPH20

The production and purification of Gen2 soluble rHuPH20 in a 300 L bioreactor cell culture contained some changes in the protocols compared to the production and purification Gen1 soluble rHuPH20 in a 100 L bioreactor cell culture (described in Example 3.B). Table 13 sets forth exemplary differences, in addition to simple scale up changes, between the methods.

TABLE 13

| Process Difference | Gen1 soluble rHuPH20 | Gen2 soluble rHuPH20 |
|---|---|---|
| Cell line | 3D35M | 2B2 |
| Media used to expand cell inoculum | Contains 0.10 μM methotrexate (0.045 mg/L) | Contains 20 μM methotrexate (9 mg/L) |
| Media in 6 L cultures onwards | Contains 0.10 μM methotrexate | Contains no methotrexate |
| 36 L spinner flask | No instrumentation 20 L operating volume. | Equipped with instrumentation that monitors and controls pH, dissolved oxygen, sparge and overlay gas flow rate. 32 L operating volume |
| Final operating volume in bioreactor | Approx. 100 L in a 125 L bioreactor (initial culture volume + 65 L) | Approx. 300 L in a 400 L bioreactor (initial culture volume + 260 L) |
| Culture media in final bioreactor | No rHuInsulin | 5.0 mg/L rHuInsulin |
| Media feed volume | Scaled at 4% of the bioreactor cell culture volume i.e. 3.4, 3.5 and 3.7 L, resulting in a target bioreactor volume of ~92 L. | Scaled at 4% of the bioreactor cell culture volume i.e. 10.4, 10.8, 11.2 and 11.7 L, resulting in a target bioreactor volume of ~303 L. |
| Media feed | Feed #1 Medium: CD CHO + 50 g/L Glucose + 8 mM GlutaMAX ™-1 Feed #2 (CD CHO + 50 g/L Glucose + 8 mM GlutaMAX + 1.1 g/L Sodium Butyrate Feed #3: CD CHO + 50 g/L Glucose + 8 mM GlutaMAX + 1.1 g/L Sodium Butyrate | Feed #1 Medium: 4x CD CHO + 33 g/L Glucose + 32 mM Glutamax + 16.6 g/L Yeastolate + 33 mg/L rHuInsulin Feed #2: 2x CD CHO + 33 g/L Glucose + 16 mM Glutamax + 33.4 g/L Yeastolate + 0.92 g/L Sodium Butyrate Feed #3: 1x CD CHO + 50 g/L Glucose + 10 mM Glutamax + 50 g/L Yeastolate + 1.80 g/L Sodium Butyrate Feed #4: 1x CD CHO + 33 g/L Glucose + 6.6 mM Glutamax + 50 g/L Yeastolate + 0.92 g/L Sodium Butyrate |
| Filtration of bioreactor cell culture | Four polyethersulfone filters (8.0 μm, 0.65 μm, 0.22 μm and 0.22 μm) in series 100 L storage bag | 1st stage - Four modules in parallel, each with a layer of diatomaceous earth graded to 4-8 μm and a layer of diatomaceous earth graded to 1.4-1.1 μm, followed by a cellulose membrane. 2nd stage - single module containing a layer of diatomaceous earth graded to 0.4-0.11 μm and a layer of diatomaceous earth graded to <0.1 μm, |

TABLE 13-continued

| Process Difference | Gen1 soluble rHuPH20 | Gen2 soluble rHuPH20 |
|---|---|---|
| | | followed by a cellulose membrane. $3^{rd}$ stage - 0.22 µm polyethersulfone filter 300 L storage bag Harvested cell culture is supplemented with 10 mM EDTA, 10 mM Tris to a pH of 7.5. |
| Concentration and buffer exchange prior to chromatography | Concentrate with 2 TFF with Millipore Spiral Polyethersulfone 30K MWCO Filter Buffer Exchange the Concentrate 6× with 10 mM Hepes, 25 mM NaCl, pH 7.0 20 L sterile storage bag | Concentrate using four Sartorius Sartoslice TFF 30K MWCO Filter Buffer Exchange the Concentrate 10× with 10 mM Tris, 20 mM Na2SO4, pH 7.5 50 L sterile storage bag |
| Viral inactivation prior to chromatography | None | Viral inactivation performed with the addition of a 1% Triton X-100, 0.3% Tributyl Phosphate, pH 7.5, |
| $1^{st}$ purification step (Q sepharose) | No absorbance reading | A280 measurements at the beginning and end |
| Viral filtration after chromatography | Pall DV-20 filter (20 nm) | Sartorius Virosart filter (20 nm) |
| Concentration and buffer exchange after chromatography | Hepes/saline pH 7.0 buffer Protein concentrated to 1 mg/ml | Histidine/saline, pH 6.0 buffer Protein concentrated to 10 mg/ml |

Example 6

Targeting Hyaluronan with Recombinant Hyaluronidase (rHuPH20) in Hyaluronan-Rich Tumors A. In Vitro Formation of Hyaluronan-Specific Pericellular Matrix Halos by Hyaluronan-Rich Tumor Cells Hyaluronan-rich tumor cell cultures and hyaluronan-deficient tumor cell cultures were assessed for the ability to form pericellular matrices (halos) in vitro, using a particle exclusion assay and immunohistochemistry. For this study, low-density cultures of hyaluronan-rich human prostate tumor carcinomas (PC3) and low-density cultures of hyaluronan-deficient human lung carcinomas (NCI H460) were treated in cell media for 60 minutes at 37° C., followed by incubation in the presence or absence of 0.5 mg/mL bovine aggrecan (commercially available) which is a large aggregating chondroitin sulfate proteoglycan at 37° C. for 60 minutes.

To assess halo formation by particle exclusion, small particles ($5\times10^6$ formalin-fixed red blood cells (RBCs)) were added to the cultures. After the particles had settled, the cultures were viewed at 400× or 100× magnification.

To assess hyaluronan expression by immunohistochemistry, a subset of the cultures were stained with biotin labeled hyaluronan binding protein (HABP-bio) (Seikagaku, Japan). After washing to remove the primary reagent, a FITC-labeled streptavidin (Vector Labs, Canada) was used as a secondary reagent. Nuclei were counter-stained using a DAPI (4',6-diamidino-2-phenylindole) reagent. Micrographs were captured via a Nikon Eclipse TE2000U microscope coupled to a Insight FireWire digital camera (Diagnostic Instruments, Michigan).

Pericellular matrix halos were identified as the areas staining positive, by immunohistochemistry, for HA, and the areas from which particles (RBCs) were excluded in the particle exclusion assay. The results revealed halos (in a representative experiment, roughly the size of a cell) in the hyaluronan-rich tumor (PC3) cultures that had been pre-treated in the presence of aggrecan. By contrast, halos did not form in the absence of aggrecan, nor in the cultures of hyaluronan-deficient (NCI H460) tumor cells, suggesting that the formation of pericellular matrices was dependent on hyaluronan expression.

To determine whether targeting hyaluronan could block the formation of these halos, the particle exclusion study and the immunohistochemistry were carried out in cell cultures that had been treated (prior to addition of aggrecan) for 60 minutes at 37° C., in the presence or absence of a soluble recombinant human hyaluronidase composition designated rHuPH20. rHuPH20 was included in the tumor cell cultures at 1000 enzymatic units per mL, as determined using the method described in Example 2, above. Immunofluorescent staining with an anti-hyaluronan antibody (commercially available) revealed an absence of hyaluronan staining after incubation with rHuPH20. Following incubation with rHuPH20, the particle assay was performed as described above. Micrographs revealed that with rHuPH20, halos did not form in the (PC3) tumor cell cultures. rHuPH20 had no effect on the hyaluronan-deficient cell (NCI H460) cultures, which did not form pericellular matrices with or without rHuPH20. These results support the indication that the in vitro halo formation in tumor cell cultures is hyaluronan-dependent.

The same particle exclusion assay was carried out with seven different types of human tumor cell lines, having varying degrees of HA expression, in the presence or absence of rHuPH20, as described in this Example, above. The cell lines used were BxPC3 (Pancreas tumor line), PC3 (prostate tumor line), MDA-MB-231 (breast tumor line), HCT 116 (colon tumor line), DU145 (prostate tumor line), MiaPaCa2 (pancreas tumor line) and the H460 (the NSC lung cancer line). A "halo per cell area" value was determined by measuring the average halo area in the culture dish (in pixels or mm$^2$), divided by average cell area in pixels or mm$^2$. In order to compare the halo per cell area in the different tumor type cell cultures, the value for BxPC3 cells was set at 100, and the value for the HA-deficient cell line H460, was set at 0, and a "relative halo fraction" was determined for each cell type by comparison. The results are set forth in Table 14, below. The numbers listed represent an average of n=25 measurements, plus or minus standard error of the mean (SEM).

TABLE 14

Relative Halo Fraction and HA Reduction by rHuPH20 in Tumor Cell Cultures

| Human tumor type | Cell line | Relative HALO Fraction −rHuPH20 | +rHuPH20 |
|---|---|---|---|
| Pancreas | BxPC3 | 100.0 ± 9.6 | 4.5 ± 0.8 |
| Prostate | PC3 | 84.2 ± 4.6 | 14.2 ± 1.2 |
| Breast | MDA-MB-231 | 82.1 ± 7.3 | 10.4 ± 1.3 |
| Colon | HCT 116 | 50.8 ± 5.7 | 9.9 ± 0.9 |
| Prostate | DU145 | 31.2 ± 4.3 | 5.5 ± 0.9 |
| Pancreas | MiaPaCa 2 | 16.7 ± 1.4 | 4.2 ± 0.7 |
| NSC Lung | H460 | 0.0 ± 0.8 | −2.3 ± 0.3 |

A timecourse study also was carried out using this assay to determine the duration of HA removal in the PC3 cultures following transient exposure of the cells to rHuPH20, followed by a "chase" period where the cells were incubated with cell media in the absence of the enzyme. As above, a "halo per cell area" value was determined by measuring the average halo area, in pixels or mm$^2$, divided by average cell area in pixels or mm$^2$. Halo per cell area was calculated prior to treatment (time zero (0)), and the value set as 100%. For each of six treated time-points, the cells were incubated in the presence of 1000 U/mL rHuPH20 for an hour, followed by a wash to remove the enzyme and a chase period, where the cells were incubated without the enzyme, for a total of 2, 4, 8, 16, 24 and 48 hours, respectively. For each time-point, halo per cell area was calculated and a relative halo fraction was determined by comparison to the 100% time zero value. The results are set forth in Table 15, below. The numbers listed represent an average of n=45 measurements, plus or minus standard error of the mean (SEM).

TABLE 15

Duration of HA Removal in PC3 Cell Cultures by rHuPH20

| Total time (hours) post addition of 1000 U/mL rHuPH20 (including 1 hour incubation and chase) | Relative halo fraction (%) |
|---|---|
| 0 | 100.00 ± 7.5 |
| 2 | 0.0 ± 2.7 |
| 4 | 3.2 ± 3.3 |
| 8 | 11.6 ± 4.4 |
| 16 | 64.4 ± 7.8 |
| 24 | 94.5 ± 5.6 |
| 48 | 92.7 ± 7.1 |

B. Intravenous rHuPH20 Administration in a Hyaluronan-Rich Tumor Model (Peritibial PC3 Prostate Carcinoma Xenograft Model) Reduces Distal Tumor Interstitial Fluid Pressure (IFP)

To analyze the effects of targeting hyaluronan in a hyaluronan-rich tumor, rHuPH20 was systemically administered in a peritibial prostate carcinoma (PC3) xenograft model. For this model, athymic male nude mice were inoculated with human prostate cancer cells, PC3 (1×10$^6$ cells in a total volume of 0.05 mL) adjacent to the right tibia periosteum. All animal studies were performed in compliance with approved IACUC protocols.

To assess tumor interstitial fluid pressure (IFP) in these animals, Milar® Mikro-tip Catheter pressure transducers (SPR-320s) were connected to an ADInstruments® PowerLab 4/30 data acquisition unit and portable laptop computer for continuous IFP measurements (units=millimeters of mercury (mmHg)). The system was calibrated and considered stable when ambient pressure measurements did not deviate by more than +/−1.0 mmHg over 15-20 minutes. For probe placement, the pressure catheter was inserted into the inner bore of a 21 gauge needle, and the needle introduced into the center of the tumor. The needle was withdrawn around the transducer, while the pressure catheter was simultaneously held in position. The system then was used to measure IFP in the tumors (mmHg).

In one exemplary experiment, baseline distal tumor IFP measurements in 26 xenograft model animals using this method, revealed a correlation between tumor volume and IFP (correlation coefficient, r=0.5652), suggesting that increased tumor volume may lead to increased IFP.

To determine whether systemic rHuPH20 treatment could reduce tumor IFP in this xenograft model, 10,000 units (as determined in Example 2) of rHuPH20, was administered in a 100 µL dose by intravenous injection in the tail vein of three animals. Prior to dosing (injection) with rHuPH20, IFP was measured for approximately 20-30 minutes, to establish a baseline IFP measurement. IFP then was measured during and following injection. IFP was measured for 1-2 hours post-rHuPH20 administration. The intravenous rHuPH20 administration caused a reduction in distal tumor IFP. Within 10 minutes, tumor IFP was reduced by an average of 34% compared to baseline. Further, tumor IFP levels dropped from 34.06±15.9 mmHg to 14.86±12.55 mmHg in one hour (an average of 38% of the baseline level; a 61.3% average reduction), the maximum reduction. Heat-inactivated rHuPH20, administered to animals as a control, did not decrease interstitial fluid pressure.

Consistent with rapid hyaluronan turnover, tumor IFP returned to baseline within 24 hours in all the mice. A repeat intravenous administration of 10,000 units rHuPH20, given 48 hours following the initial dose, revealed a similar drop in IFP (28.6% of baseline, average). Measurements taken before and after rHuPH20 administration in non-tumor bearing limbs revealed no change in interstitial fluid pressure in these tissues. These data indicated that systemic, intravenous administration of hyaluronidase can be used to reduce interstitial fluid pressure in distal tumors.

Interstitial fluid pressure also was measured in a xenograft model generated similarly, by injection of the hyaluronan-deficient lung carcinoma cells (H460). While tumors in this model exhibited high interstitial fluid pressure, the effects of intravenous administration of rHuPH20 was much less pronounced in this model compared to the hyaluronan-rich tumor model, supporting the indication that the effect of rHuPH20 on tumor interstitial pressure is hyaluronan-dependent.

Example 7

PEGylation of rHuPH20

A. Conjugation of mPEG-SBA-30K to rHuPH20

In order to generate a PEGylated soluble human hyaluronidase, rHuPH20 (which is approximately 60 KDa in size) was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown in scheme 2, below:

Scheme 2

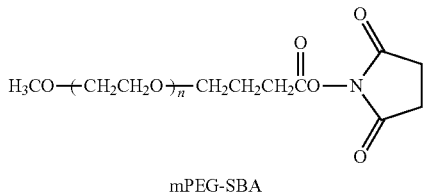

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford mPEG-SBA-30K.

To make the PEGylated rHuPH20, mPEG-SBA-30K was coupled to the amino group(s) of rHuPH20 by covalent conjugation, providing stable amide bonds between rHuPH20 and mPEG, as shown in Scheme 3.

Scheme 3:

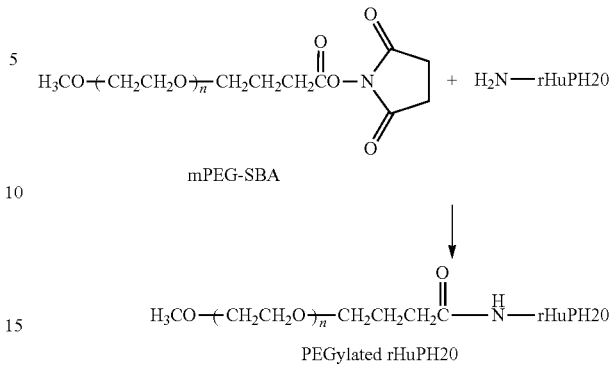

For the conjugation, the mPEG-SBA-30K was added in powder form to rHuPH20 (at a concentration of 10 mg/mL in 130 mM NaCl/10 mM HEPES; pH 7). The PEG:rHuPH20 ratio was 10:1 (molar ratio). After the PEG had dissolved in the buffer, the solution was sterile-filtered (Corning 50 mL Tube top filter, polystyrene, cellulose acetate 0.22 μm membrane). The conjugation was carried out overnight, with stirring, at 4° C. in a cold room.

Following conjugation, the solution was concentrated, using a 100,000 MWCO TFF membrane, and buffer exchanged against 130 mM NaCl/10 mM HEPES at pH 6.8. The resulting material, which was tested for enzyme activity, as described in Example 2, above, was diluted using 130 mM NaCl/10 mM HEPES at pH 6.8 to obtain a final enzyme activity of 100,000 U/mL (corresponding to approximately 2.5 mg peptide/mL). This PEGylated rHuPH20 material was filled, in 1 mL volumes, into a 13-mm Type-1 glass vial with brombutyl seal, and stored frozen (frozen overnight in a −20° C. freezer, then put in a −80° C. freezer for longer storage).

B. Analysis of PEGylated rHuPH20

The PEGylated rHuPH20 material was assayed by gel electrophoresis. Three batches of PEGylated rHuPH20, made as in Example 7A above, revealed an identical pattern of multiple bands, representing unreacted PEG and multiple species of mPEG-rHuPH20 conjugates, which migrated at different distances. Based on comparison with migration of a molecular weight marker, the bands representing the species ranged from approximately 90 KDa to 300 KDa, with three dark bands migrating above the 240 KDa marker. These data indicated that the PEGylated rHuPH20, generated by covalent conjugation of mPEG-SBA-30K, contained a heterogeneous mixture of PEGylated rHuPH20 species, likely including mono-, di- and tri-PEGylated proteins. The lack of a visible band at 60 KDa suggested that all the protein had reacted with the PEG, and that no detectable native rHuPH20 was present in the mixture.

C. Dose-Dependent Reduction of Hyaluronan-Specific Pericellular Matrix Halos in Hyaluronan-Rich Tumor Cells by PEGylated rHuPH20

With an assay similar to that described in Example 6A, the effects of various doses of PEGylated rHuPH20 on formation of pericellular matrices (halo's) in hyaluronan-rich human prostate tumor carcinoma (PC3) cells were assessed. For this assay, various low-density cultures of PC3 cells were treated with cell media alone (control; 0), or PEGylated rHuPH20 (at 3, 30, 300, 1000 or 3000 enzymatic units per mL (U/mL), as determined using the method described in Example 2, above), for 60 minutes at 37° C. The cultures then were incubated with 0.5 mg/mL bovine aggrecan (commercially available; large aggregating chondroitin sulfate proteoglycan) at 37° C. for 60 minutes.

To visualize the amount of HA in they cultures using HA (hyaluronan) protein immunohistochemistry (IHC), cells then were stained with biotin labeled biotin labeled hyaluronan binding protein (HABP-bio) (Seikagaku, Japan). After washing to remove the primary reagent, a FITC-labeled streptavidin (Vector Labs, Canada) was used as a secondary reagent. Nuclei were counter-stained using a DAPI (4',6-diamidino-2-phenylindole) reagent. Micrographs were captured via a Nikon Eclipse TE2000U microscope coupled to a Insight FireWire digital camera (Diagnostic Instruments, Michigan).

For red blood cell (RBC) particle exclusion assay, $5 \times 10^6$ formalin-fixed red blood cells) were added to each culture. After the particles had settled, the cultures were viewed at 100× magnification. Pericellular matrix halos were identified as the areas staining positive by IHC for HA, and the areas from which particles (RBCs) were excluded in the particle exclusion assay.

The "halo area" was determined by measuring the pixels staining positively for HA (immunohistochemistry), or the $mm^2$ of the area from which RBCs were excluded (particle exclusion assay). The average cell area was determined in a similar manner in pixels or $mm^2$ for each assay, respectively. The "halo area per cell area" then was derived by dividing the halo area by the average cell area for fields for each sample. "Percent halo" then was determined by setting the halo area per cell for the control sample (media alone) as 100% and the halo area per cell for the 1000 U-PH20-treated hyaluronan-degraded H460 cells (from Example 6A, above) as zero. The results are presented in Table 16, below. This Table lists the average "percent halo" for each study condition (doses of PEGylated rHuPH20); each condition was performed in triplicate wells and 25 cells counted per well (total n=75 cells counted); standard error of the mean (SEM) is shown. The data revealed that the half maximal effective concentration ($EC_{50}$) of PEGylated rHuPH20 in reducing Halos in this study was 3.1 U/mL (0.09 µg/mL). The 75% maximal effective concentration ($EC_{75}$) was 14.1 U/mL (0.4 µg/mL).

TABLE 16

Dose-Dependent Reduction in Halo Formation in Hyaluronan-Rich Tumor Cell Cultures Treated with PEGylated rHuPH20

| Dose PEG-rHuPH20 (U/mL) | % Halo | SEM |
|---|---|---|
| 0 | 100 | 4.2 |
| 3 | 51.5 | 3.1 |
| 30 | 12.3 | 1.4 |
| 300 | 9.8 | 1.0 |
| 1000 | 4.8 | 0.6 |
| 3000 | 0 | 0.5 |

D. PEGylated rHuPH20 Inhibits Colony Growth of PC3 Cells In Vitro

To determine whether PEGylated rHuPH20 can inhibit anchorage-independent growth and proliferation of hyaluronan-rich prostate tumor cells (PC3) in vitro, a three-dimensional clonogenic assay was performed on cells. PC3 cells, at approximately 80% confluency, were trypsinized, harvested, and washed once in completed medium. Cell density was adjusted to $8 \times 10^4$/mL cells and suspended in Matrigel® (BD Biosciences, San Jose, Calif.) on ice. 0.025 mL of this cell/Matrigel® mixture were seeded onto a 48 well cell culture plate that had been pre-coated with Matrigel® at 0.1 mL per well, and solidified at 37° C. for 1 hour. For continuous exposure, over 17 days, to control API buffer and various concentrations of PEGylated rHuPH20, 0.6 mL/well of completed medium containing API buffer, 1, 3, and 100 U/mL of PEGylated rHuPH20 were added to the top of the appropriate well. The wells were incubated at 37° C., in a humidified atmosphere with 5% CO2 in air for 17 days, fresh treatment medium, including the appropriate concentration of enzyme, where appropriate, was replace every 3-4 days during the 17 days period.

On day 17, growth of colonies was assessed by capturing images with a Nikon Eclipse TE2000U inverted microscope coupled to an Insight FireWire digital camera (Diagnostic Instruments, Michigan). The colony number and diameter of each colony in µm were measured using ImageJ software (open source software, a publicly available program for display and analysis of images, for calculating area and pixel value) and coupled calibration function (colony volumes were calculated using colony diameter and using the formula: $4/3 \pi r^3$.

Average colony volume of wells for each condition were determined and the effects of PEGylated rHuPH20 on colony volume assessed by comparing the average colony volume in the control sample (API (active pharmaceutical ingredient) buffer (10 mM Hepes and 130 mM NaCl, pH 7.0) without enzyme) to the samples that were incubated in the presence of PEGylated rHuPH20. Inhibitory ratios were calculated using the formula:

(mean volume of control−mean volume of treated)/ (mean volume of control)*100.

PEGylated rHuPH20 induced a dose-dependent inhibition of growth, evidenced by lower colony volume compared with control. Based on inhibitory ratios calculated using the above formula, the cultures incubated in the presence of PEGylated rHuPH20 at 1, 3, 10, and 100 U/mL exhibited an average reduction in colony volume of 39%, 67%, 73%, and 75% respectively ($p<0.01$ for the 3 U and 10 U samples; $p<0.001$ for the 100 U samples; n=6), compared to cultures incubated with control buffer. Statistical differences were analyzed using the Mann-Whitney Test.

The $IC_{50}$ of PEGylated rHuPH20 in reducing colony volume, determined using the Graphpad Prism®4 program (GraphPad Software, Inc., La Jolla, Calif.), was approximately 1.67 U/mL. The average number of colonies was 10.17±1.56 per well in vehicle-treated (control) cultures and 11.50±0.89 per well in the cultures treated with PEGylated rHuPH20100 U/mL. The difference in colony number was not significant between the control and the 100 U/mL cultures (n=6, p>0.05). These results indicate that PEGylated rHuPH20 can inhibit proliferation and/or survival of hyaluronan rich cancer cells.

Example 8

PEGylated rHuPH20: Increased Duration of In Vivo Action Compared with Native rHuPH20

A. Evaluation of the Pharmacodynamics of Native rHuPH20 and PEGylated rHuPH20

1. Evaluation of the Pharmacodynamics of Native rHuPH20.

Ninety male CD-1 mice were obtained from Charles River Laboratories. The animals were of approximately 3 to 5 weeks old and weighed about 17 to 23 grams at the day of randomization. Animals were dosed via tail vein injection (intravenous) of either 0.398 mg/kg HUA (Lot No.

HUA0703MA; generated using Gen1 production described in Example 3) or 0.433 mg/kg HUB (Lot No. HUB0702CA; generated using Gen2 production described in Example 4) rHuPH20. The intravenous injection was by a slow push taking approximately 30 seconds. Six animals dosed with PH20 (HUA or HUB) were anesthetized/euthanized for blood collection at predose, at 1, 5, 10, 30 minutes, and at 1, 2, and 3 hours post dose. Plasma samples were harvested and stored frozen until rHuPH20 concentration measurement.

Plasma concentrations of rHuPH20 were determined using a 96-well plate-based enzymatic assay. The enzyme assay was a modification of the method described by Frost et al. (1997) (A Microtiter-Based Assay for Hyaluronidase Activity Not Requiring Specialized Reagents. Analytical Biochemistry (1997) 251:263-269) that provides a measure of rHuPH20 content in plasma specimens or tissue homogenates. First, biotinylated HA (bHA) substrate was bound to plastic microtiter plates. rHuPH20 present in standards and specimens was incubated in these bHA-coated plates for approximately 90 minutes at 37° C. under optimized conditions. After stopping the enzyme reaction, remaining bound bHA was detected by initially adding a streptavidin-HRP conjugate for 60 minutes and then subsequently visualizing the response using TMB substrate. Since more rHuPH20 in a standard or sample would lead to less bHA available to bind SA-HRP, the optical density (450 nm) value was inversely proportional to the concentration of hyaluronidase activity in each specimen. The assay range was from approximately 0.013 to 1 U/mL. For a 50-fold sample dilution factor, the LLOQ was approximately 0.625 U/mL. Hence, the lower limit of quantitation (LLOQ) of the assay with a 1:100 dilution of the sample was 0.625 U/mL of enzyme. Pharmacokinetic (PK) analysis was conducted using WinNonlin Pro version 5.1 (Pharsight Corp., Mountain View, Calif.). PK parameters were derived using non-compartmental methods. Summary statistics were computed using EXCEL (Microsoft Corp., Seattle, Wash.) or JMP v.5.0.1 (SAS Institute, Cary, N.C.). ANOVAs were conducted using JMP v.5.0.1.

Peak plasma concentrations of rHUPH20 (HUA and HUB) were attained immediately upon initiation of IV infusion (at the 1-minute collection time). The average peak concentration (Cmax) for HUA and HUB were 1148 and 1176 ng/mL, respectively. Decline from peak concentration was rapid and bi-phasic for both HUA and HUB. The initial distribution phase, between 1 and 5 minutes post dose, was followed by a slightly slower elimination phase. Plasma concentrations fell below the assay quantitation limit (0.625 U/mL) by 30 minutes post dose. The terminal half-life (T1/2 λz) from the IV injection was 0.045 hour (2.6 minutes) for HUA and was 0.038 hours (2.3 minutes) for HUB. The short half-life represented rapid elimination of rHuPH20 in male CD-1 mice.

2. Evaluation of the Pharmacodynamics of PEGylated rHuPH20

A singe dose PK study was conducted in male IRC mice (Harlan) to characterize and compare the plasma concentration versus time profiles for two lots of PEGylated rHuPH20 (PEGPH20); lots 2005-9-14 (specific activity 38,000 U/mg) and lot 221-092 (specific activity 32,000 U/mg). Additionally, the PK concentration following repeated Monday-Thursday BIW (twice-a-week) IV injections were examined in one study group of animals.

PEGPH20 (made as described in Example 7A) was administered intravenously to male IRC mice, weighing more than 25 g; the IV dose was 125,000 hyaluronidase activity units per kilogram body weight (U/kg). Blood samples were collected prior to dosing and at pre-determined times post dose. Due to the limited blood volume of a mouse, a sparse sampling scheme was used for sequential blood collections. Randomization of study animals and sparse blood collection times are shown in Table 16A.

TABLE 16A

Randomization and Sparse Blood Collection Scheme

| Group | N/group | Test Article | Dose | Time Points for Blood Withdrawals |
|---|---|---|---|---|
| 1 | 3 | PEGPH20 Lot #221-092 | 125,000 U/kg | 5 min, 30 min, 1 h, 24 h |
| 2 | 3 | PEGPH20 Lot #2005-9-14 | 125,000 U/kg | 5 min, 30 min, 1 h, 24 h |
| 3 | 3 | PEGPH20 Lot #221-092 | 125,000 U/kg | 1 h, 2 h, 4 h, 24 h |
| 4 | 3 | PEGPH20 Lot #2005-9-14 | 125,000 U/kg | 1 h, 2 h, 4 h, 24 h |
| 5 | 3 | PEGPH20 Lot #221-092 | 125,000 U/kg | Pre, 4 h, 8 h, 24 h |
| 6 | 3 | PEGPH20 Lot #2005-9-14 | 125,000 U/kg | 4 h, 8 h, 24 h |
| 7 | 3 | PEGPH20 Lot #2005-9-14 | 125,000 U/kg per dose | 1 h, 4 h, 24 h, 48 h, 72 h - first dose 1 h, 4 h, 24 h, 48 h, 96 h - second dose 1 h, 4 h, 24 h, 48 h - third dose |

Plasma was prepared from collected blood samples and stored frozen at −70° C. until analysis. Hyaluronidase activity in each plasma sample was determined by a micro turbidity microtiter plate based-assay described in Example 2. The lower limit of quantitation for the assay was 2.90 U/mL. Plasma concentration versus time data was analyzed by non-compartmental and compartmental methods using WinNonlin Pro version 5.1 (Pharsight Corp., Mountain View, Calif.). Derived PK parameters included AUC, Cmax, and Tmax. These parameters were compared between the two lots of PEGPH20 to assess PK comparability. A general specific activity of 35,000 U/mg was used for conversion of U/mL to μg/mL. The 35,000 U/mg was an average of the specific activities of the 2 lots of PEGPH20 (lots 221-092 and 2005-9-14).

Systemic exposure defined by AUC and Cmax were similar between the two lots of PEGPH20 when administered intravenously to mice. The general PK profiles from the two lots were also similar with prolonged elimination half-life of about 10 to 11 hours and a slow systemic clearance of less than 10 mL/h-kg. Statistical comparison of mean and median plasma concentrations by blood collection times showed no significant differences between the 2 lots of PEGPH20. Repeated BIW (Monday-Thursday) IV administration of PEGPH20 for a total of 3 doses gave expected plasma concentrations that could be predicted by the pharmacokinetics of the first dose. These results suggested that PEGylated rHuPH20 has a sustained in vivo enzymatic activity following administration by intravenous injection, having greater than a about 250-fold increase in half-life.

B. In Vivo Activity in the Hyaluronan-Rich Tumor Model (Peritibial PC3 Prostate Carcinoma Xenograft Model)

To compare the effects of PEGylated and native rHuPH20 following intravenous administration, the peritibial PC3 prostate carcinoma xenograft model animals, described in Example 6, above, were treated with native and PEGylated rHuPH20.

1. Increased Duration of Hyaluronidase Enzymatic Activity in Plasma Following Administration of PEGylated rHuPH20

Two groups of peritibial PC3 prostate carcinoma xenograft model animals (athymic males bearing PC3 human prostate cancer xenografts; see Example 6, above) were injected intravenously with 10,000 units of PEGylated rHuPH20 (made as described in Example 7A) and native rHuPH20, respectively.

Blood was taken from the animals prior to administration of 10,000 units of native rHuPH20/PEGylated rHuPH20, and at various time-points following administration. Plasma was prepared and the enzymatic activity assay described in Example 2, above, was used to determine the units of rHuPH20 activity per mL plasma at these time-points. The results revealed that the half-life of enzymatic activity in the plasma after administration of native rHuPH20 was less than one minute (plasma half-life was 0.59 minutes in this experiment). By 10 minutes following administration of native rHuPH20, less than 5 enzymatic units per mL of plasma was observed.

By contrast, PEGylated rHuPH20 exhibited a plasma enzymatic half life of over 24 hours. At 60 minutes following administration of 10,000 enzymatic units of PEGylated rHuPH20, greater than 1000 enzymatic activity units (greater than 10% of that injected) were observed per mL of plasma. These results suggested that PEGylated rHuPH20 has a sustained in vivo enzymatic activity following administration by intravenous injection, having greater than a 2000-fold increase in half-life.

2. Increased Duration of Hyaluronan Reduction in Distal Tumors with PEGylated rHuPH20

Peritibial tumors from the mice described in Example 8B.1, above, were harvested and fixed in normal buffered formalin (NBF), prior to native/PEGylated rHuPH20 administration, and 45 minutes, 2 hours, 24 hours, 48 hours and 72 hours post-administration. Levels of hyaluronan (HA) in the tumors were assessed by immunohistochemistry (IHC). For IHC, 5 µm tumor sections were stained using a biotin labeled hyaluronan binding protein (HABP-bio) (Seikagaku, Japan). After washing to remove the primary reagent, a FITC-labeled streptavidin (Vector Labs, Canada) was used as a secondary reagent. Nuclei were counter-stained using a DAPI (4',6-diamidino-2-phenylindole) reagent. Micrographs were captured via a Nikon Eclipse TE2000U microscope coupled to a Insight FireWire digital camera (Diagnostic Instruments, Michigan).

Before rHuPH20 administration, an intense green staining was indicative of the presence of HA in the tumors. Forty-five (45) minutes after intravenous administration of 10,000 Units native rHuPH20, tumors displayed no visible HA staining. However, within 24 hours, HA levels in the tumors appeared to have returned to that observed prior to dosing, consistent with rapid hyaluronan turnover and short half-life of native rHuPH20. Following administration of PEGylated rHuPH20, however, no HA staining was observed at 2 hours, 48 hours, nor 72 hours, following administration. These results suggested that intravenous administration of PEGylated rHuPH20 results in sustained enzymatic activity at the tumor site, for at least 72 hours following administration.

3. Dose Response of HA-Degradation in Distal Tumors by PEGylated rHuPH20

In another study, animals in an additional group of peritibial PC3 prostate carcinoma xenograft model animals were treated with vehicle and various amounts concentrations (10, 100, 500, 1000 and 10,000 enzymatic units (U) per mouse) of PEGylated rHuPH20. Three days (72 hours) following this treatment, peritibial tumors from the mice were harvested and fixed in normal buffered formalin. Levels of hyaluronan (HA) in the tumors were assessed by immunohistochemistry (IHC), as described in Example 8B.2, above. Hematoxylin/Eosin (H&E) staining also was done on the tumor sections. The results revealed a dose-dependent reduction in HA staining in the tumor sections from animals treated with 100, 500, 1000 and 10,000 U PEGylated rHuPH20. In the sections from animals receiving 1000 and 10,000 U PEGylated rHuPH20, almost no visible staining was observed. In the sections of animals that had received 500 U PEGylated rHuPH20, sporadic staining was observed, indicating that in this exemplary study, HA staining was completely removed only with doses greater than 500 (in this case, 1000) U. These results indicated that a single systemic administration of PEGylated rHuPH20 can reduce hyaluronan in distal tumors for at least three days. The $ED_{50}$ (dose eliciting a 50% reduction in HA staining) of the PEGylated rHuPH20 in this study was 13,000 enzymatic units per kilogram (U/Kg), which corresponds to 300 µg/Kg.

4. Duration of Action of PEGylated PH20 Removal of HA from Distal PC3 Tumors

In a further study, PC3 prostate tumor model animals were treated with vehicle for ten days, or 10,000 Upper mouse (approximately 15 mg/Kg) of PEGylated rHuPH20 for 1, 2, 3, 4, 5, 6, 7, 8, 9 or 10 days. After the treatment, peritibial tumors from the mice were harvested and fixed in normal buffered formalin and assessed for hyaluronan (HA) expression via immunohistochemistry as described in Example 8B.2, above. HA staining was reduced at all time points, with no visible detection of HA staining out to day 5.

Example 9

Sustained IFP Suppression with PEGylated rHuPH20

A. PEG•rHuPH20 Administration Results in Rapid, Sustained, Dose-Dependent Reduction in Tumor IFP.

In order to compare the effects of systemic administration of PEGylated rHuPH20 (PEG rHuPH20) and native rHuPH20 on distal tumor IFP, the method described in Example 6B, above, was used to measure tumor IFP after intravenous injection of various amounts of each enzyme in PC3 xenograft model animals.

First, reduction in tumor IFP was compared, using three mice per group, each mouse receiving a 10,000 unit dose of either PEG rHuPH20 or native rHuPH20. As noted in Example 6B, above, with administration of native rHuPH20, tumor IFP was reduced by an average of 34% in 10 minutes and 61.3% in one hour, following administration. Administration of 10,000 units of PEG rHuPH20 resulted in a similar (22.4%) reduction in the first ten minutes following injection. By one hour post-administration, however, the PEG rHuPH20 had reduced the distal tumor IFP by an average of 88.6%, compared to baseline, indicating that PEGylated soluble hyaluronidase has an increased and/or sustained effect on IFP compared with native enzyme.

Next, in order to determine whether the effect of rHuPH20 on interstitial fluid pressure were dose-dependent, the method described in Example 6B, above, was carried out using 10 groups of PC3 xenograft mice (7 mice per group), each group being treated as described above, with 100, 1000, 3000, 7000 (PEGylated rHuPH20 only) or 10,000 units of PEGylated or native rHuPH20, or control carrier buffer, was administered intravenously by tail vein injection. IFP was measured prior to, during and continuously following the administration. IFP was measured until 120 minutes post-administration.

Results revealed that intravenous administration of both native and PEGylated rHuPH20 reduced distal tumor IFP in a dose-dependent manner. Several doses of PEGylated rHuPH20 resulted in greater decreases in IFP by one and two hours following administration. For example, in this exemplary experiment, after 120 minutes, administration of 1000 units of native rHuPH20 resulted in an approximately 30% reduction in tumor IFP (roughly 70% compared to control), while administration of the same dose (1000 units) of PEG rHuPH20 reduced tumor IFP by greater than 50% (roughly 48% of control). IFP reduction at the highest doses (3,000-10,000 U/mouse) of PEGylated rHuPH20 was greater than 80% at 120 minutes. $IC_{50}$ (for % IFP inhibition at 120 minutes following PEGylated rHuPH20 treatment) was 807.6 U/mouse. The three highest dose (3000, 7000 and 10,000 U PEGylated rHuPH20/mouse) effects appeared to plateau at this time-point.

B. Intravenous Administration of PEGylated rHuPH20 Results in Prolonged Tumor IFP Suppression To determine whether the increased duration of in vivo activity with PEGylated rHuPH20, as observed in Example 8, translated into prolonged suppression of tumor IFP, groups of PC3 xenograft model animals (4 animals per group) were injected intravenously with carrier buffer or 10,000 units of PEGylated rHuPH20 as described above, and IFP measured, as described in Example 6B, at 8 hours, 24 hours, 48 hours and 72 hours post administration.

Similar experiments had shown that distal tumor IFP returned to control levels by 24 hours following administration of native rHuPH20. By contrast, in this experiment, IFP was reduced by at least about 50% at 8 hours, 24 hours and 48 hours following intravenous administration of a single dose of 10,000 units PEGylated rHuPH20. In this experiment, the average tumor IFP approached control levels by 72 hours. These results indicate that PEGylated rHuPH20 can be administered intravenously to effect prolonged interstitial fluid pressure decreases at distal tumor sites.

C. Reduction in Tumor IFP by PEGylated rHuPH20 Administration is HA-Dependent

To demonstrate that reduction in tumor IFP by PEGylated rHuPH20 was dependent on presence of hyaluronic acid (HA) in the tumor, the effect on IFP was assessed in five different tumor models. For this study, groups of animals for each tumor model were generated by inoculating male athymic nude (nu/nu) mice with the appropriate cell lines: PC3 (described above, e.g. Example 6); BxPC3 (a human pancreatic carcinoma cell line); Mat LyLu (a rat prostatic carcinoma derived from the Dunning series of rat prostate carcinomas); Du145 (a human hormone refractory prostate carcinoma cell line); and NCI H460 (a human large cell lung carcinoma cell line), in the hind limb, peritibially, as described for the PC3 model (See Example 6, above).

As described in Example 17, below, tumors isolated from these mice were assessed by immunohistochemistry (IHC) for differences in the degree of HA expression. The IHC was performed on sections from the tumors and a scoring system was used, where a "+++" score indicated intense staining in greater than 80% of the visual field, "+/−" indicated sparse staining and "−" indicated no visible staining. As noted in Example 17 and in Table 17 below, this study revealed a range of HA levels in tumors, ranging from +++ to +/−.

Animals from the PC3 prostate tumor model, BxPC3 pancreatic carcinoma tumor model, Mat LyLu prostate tumor model, Du145 human prostate tumor model, and NCI H460 lung carcinoma model, having tumors that had reached between 400 and 800 $mm^3$ then were injected intravenously with 15 mg/Kg (10,000 Upper mouse) PEGylated rHuPH20 or control buffer (API (active pharmaceutical ingredient) buffer (10 mM Hepes and 130 mM NaCl, pH 7.0) without enzyme). The relative amounts of tumor HA in each of these models, as determined as described in Example 17A, below, is set forth in Table 17, below.

IFP was measured, as described in Example 6B, above, prior to, during and continuously following the administration. IFP was measured until 120 minutes post-administration. Table 17, below, indicates the approximate relative reduction in IFP (compared to treatment with control buffer) at 120 minutes, for each tumor model. For these numbers, IFP was compared in the animals that received PEGylated rHuPH20, to that in animals receiving control buffer. The results indicate that PEGylated rHuPH20 intravenous administration reduces IFP in distal tumors in an HA-dependent manner.

TABLE 17

Reduction in Tumor IFP by PEGylated rHuPH20 Depends on HA amounts in Tumors

| Tumor Model | Relative Tumor HA | Approximate Relative IFP Reduction |
|---|---|---|
| PC3 | +++ | 84% |
| BxPC3 | +/++ | 30% |
| Mat LyLu | + | 25% |
| Du145 | +/− | 19% |
| NCI H460 | +/− | 16% |

Example 10

Intravenous Administration of rHuPH20 Results in Increased Vascular Volume in Distal Tumors (Sustained Effects with PEGylated rHuPH20)

Transverse 2-dimensional ultrasound imaging was used to measure vascular volume before and after rHuPH20 administration in peritibial tumors in the xenograft model described in Example 6, above.

A VisualSonics Vevo 770® high resolution ultrasound (U/S) (VisualSonics, Inc., Toronto, Ontario, Canada) was used, in Contrast Mode, to obtain relative measurements of vascular volume in the tumors. During Contrast Mode image acquisition, non-targeted nitrogen/perfluorobutane filled MicroMarker® microbubbles (MBs) (VisualSonics, Inc.), which are not, but become trapped in the vascular space due to their size, were administered intravenously by tail vein injection. The MBs were hyper-echoic, thus providing strong ultrasound wave reflections and had a median diameter of 2.3-2.9 mm. Thus, the MBs were confined to the vascular compartment following injection. Relative vascular volume was calculated, using the equation below, as ultrasound signal intensity after MB injection (B) minus ultrasound signal intensity prior to MB injection (A), per tumor region of interest (ROI):

$$\text{Vasc Vol}(\tau 1) = [(B-A)/\text{ROI}]$$

The change in relative vascular volume was the difference in the vascular volume (as calculated with the equation above) at two time points (e.g. before and following administration of rHuPH20), as per the following equation:

$$\text{Change in Vasc Vol} = \text{Vasc Vol}(\tau 2) - \text{Vasc Vol}(\tau 1)$$

Using these methods, vascular volume in peritibial tumors was measured 8 hours, 24 hours, 48 hours and 72 hours following intravenous administration of soluble human hyaluronidase (native or PEGylated) to xenograft model animals, as described in Examples 6 and 9 above. At eight and twenty-four hours post-administration of native rHuPH20, distal tumor vascular volume was between 2 and 2.5-fold higher than after injection of carrier buffer alone. At eight and twenty-four hours post-administration of PEGylated rHuPH20, however, the vascular volume was between 3 and 4-fold higher than after injection of buffer alone. By 48 hours following administration of the PEGylated rHuPH20, the tumor vascular volume was still increased 3-fold compared to the vascular volume observed after injection with buffer alone. These results indicate that systemic administration of PEGylated rHuPH20 can effect sustained "enzymatic decompression" of tumor vessels, resulting in increased vascular volume.

Enzymatic decompression of tumor blood vessels was also assessed by immunohistochemistry (IHC) for visualization of blood vessels. Peritibial tumors from groups (of 3 PC3 xenograft model animals each), which had been treated with carrier buffer or 10,000 Units PEGylated rHuPH20 were harvested, fixed in formalin and embedded in paraffin. For detection of blood vessels, sections from the tumors were stained using a rat anti-mouse CD31 antibody (Pharmingen, San Diego). After washing the primary antibody, the sections were stained with HRP-conjugated rabbit anti-rat IgG (Vector Labs, Canada). After washing the secondary antibody, a DAB substrate was used to visualize CD31 staining. Nuclei were counter stained with hematoxylin. Micro-vessel area was quantified using ImageJ open source software, a publicly available program for display and analysis of images, for calculating area and pixel value. In this case, the program was used to measure the area inside the CD31 positive microvessels. The results revealed an average CD31+ microvessel area of approximately 200 square micrometers ($\mu m^2$) in tumor sections from the control-treated animals, and of approximately 700 $\mu m^2$ in tumor sections from mice that had received intravenous doses of PEGylated rHuPH20 48 hours prior. This greater than three-fold increase supported the finding that PEGylated rHuPH20 administration effects a sustained enzymatic decompression of tumor blood vessels.

Example 11

Intravenous Administration of PEGylated rHuPH20 Results in Sustained Decrease in Tumor Water Content Tumor water content was measured in groups of PC3 xenograft animals (9 mice per group) at various time points following intravenous administration, as described in the above Examples, of 10,000 Units PEG•rHuPH20 or carrier buffer alone. Water content was measured 2, 8, 24, 48, 72, 96 and 120 hours following administration.

To measure water content, PC3 tumors pieces were harvested, blotted, weighed, and snap frozen. Samples were subsequently placed in a lyophilizer, dried for over 48 hrs and weighed. Water weight was reported as the tissue wet weight to dry weight ratio. Results revealed that wet/dry weight ratio was significantly reduced (p<0.05) in the mice having received PEG rHuPH20, relative to animals having received carrier buffer injection, at all time points measured.

Relative H2O Diffusion Rate (ADC)— Animals were administered native rHuPH20, PEG-rHuPH20, or carrier buffer and Diffusion Weighted MRI measured over time to determine Apparent Diffusion Coefficients (ADCs) (see, for example, Park M J et. al, *Korean J. Radiol.* 2007 (5):390-6, *The role of diffusion-weighted imaging and the apparent diffusion coefficient (ADC) values for breast tumors*). The ADC value reflected tumor water content. At both 48 and 72 hrs after dosing, the mean H2O apparent diffusion coefficient (ADC) after PEG•rHuPH20 treatment was statistically different than treatment with carrier buffer alone. The reduction in water ADC reflected a decrease in water diffusion/translational motion in the tumors in animals treated intravenously by PEGylated rHuPH20. Thus, water diffusion was significantly decreased in tumors in these animals at both 48 and 72 hours, relative to control. This result indicates that the interstitial volume fraction was decreased and/or that the tortuosity of interstitial fluid was decreased, following intravenous administration of PEGylated rHuPH20, for at least 72 hours.

Example 12

Determination of Sialic Acid and Monosaccharide Content

The sialic acid and monosaccharide content of soluble rHuPH20 can be assessed by reverse phase liquid chromatography (RPLC) following hydrolysis with trifluoroacetic acid. In one example, the sialic acid and monosaccharide content of purified hyaluronidase lot # HUB0701E (1.2 mg/mL; produced and purified essentially as described in Example 5) was determined. Briefly, 100 µg sample was hydrolyzed with 40% (v/v) trifluoroacetic acid at 100° C. for 4 hours in duplicate. Following hydrolysis, the samples were dried down and resuspended in 300 µL water. A 45 µL aliquot from each re-suspended sample was transferred to a new tube and dried down, and 10 µL of a 10 mg/mL sodium acetate solution was added to each. The released monosaccharides were fluorescently labeled by the addition of 50 µL of a solution containing 30 mg/mL 2-aminobenzoic acid, 20 mg/mL sodium cyanoborohydride, approximately 40 mg/mL sodium acetate and 20 mg/mL boric acid in methanol. The mixture was incubated for 30 minutes at 80° C. in the dark. The derivatization reaction was quenched by the addition of 440 µL of mobile phase A (0.2% (v/v) n-butylamine, 0.5% (v/v) phosphoric acid, 1% (v/v) tetrahydrofuran). A matrix blank of water also was hydrolyzed and derivatized as described for the hyaluronidase sample as a negative control. The released monosaccharides were separated by RPLC using an Octadecyl ($C_{18}$) reverse phase column (4.6×250 mm, 5 µm particle size; J. T. Baker) and monitored by fluorescence detection (360 nm excitation, 425 nm emission). Quantitation of the monosaccharide content was made by comparison of the chromatograms from the hyaluronidase sample with chromatograms of monosaccharide standards including N-D-glucosamine (GlcN), N-D-galactosamine (GalN), galactose, fucose and mannose. Table 18 presents the molar ratio of each monosaccharide per hyaluronidase molecule.

TABLE 18

Monosaccharide content of soluble rHuPH20

| Lot | Replicate | GlcN | GalN | Galactose | Mannose | Fucose |
|---|---|---|---|---|---|---|
| HUB0701E | 1 | 14.28 | 0.07* | 6.19 | 25.28 | 2.69 |
| | 2 | 13.66 | 0.08* | 6.00 | 24.34 | 2.61 |
| | Average | 13.97 | 0.08* | 6.10 | 24.81 | 2.65 |

*GalN results were below the limit of detection

Example 13

C-Terminal Heterogeneity of Soluble rHuPH20 from 3D35M and 2B2 Cells

C-terminal sequencing was performed on two lots of sHuPH20 produced and purified from 3D35M cells in a 100 L bioreactor volume (Lot HUA0505MA) and 2B2 cells in a 300 L bioreactor volume (Lot HUB0701EB). The lots were separately digested with endoproteinase Asp-N, which specifically cleaves peptide bonds N-terminally at aspartic and cysteic acid. This releases the C-terminal portion of the soluble rHuPH20 at the aspartic acid at position 431 of SEQ ID NO:4. The C-terminal fragments were separated and characterized to determine the sequence and abundance of each population in Lot HUA0505MA and Lot HUB0701EB.

It was observed that the soluble rHuPH20 preparations from 3D35M cells and 2B2 cells displayed heterogeneity, and contained polypeptides that differed from one another in their C-terminal sequence (Tables 19 and 20). This heterogeneity is likely the result of C-terminal cleavage of the expressed 447 amino acid polypeptide (SEQ ID NO:4) by peptidases present in the cell culture medium or other solutions during the production and purification process. The polypeptides in the soluble rHuPH20 preparations have amino acid sequences corresponding to amino acids 1-447, 1-446, 1-445, 1-444 and 1-443 of the soluble rHuPH20 sequence set forth SEQ ID NO:4. The full amino acid sequence of each of these polypeptides is forth in SEQ ID NOS: 4 to 8, respectively. As noted in tables 19 and 20, the abundance of each polypeptide in the soluble rHuPH20 preparations from 3D35M cells and 2B2 cells differs.

TABLE 19

Analysis of C-terminal fragments from Lot HUA0505MA

| Fragment | Amino acid position (relative to SEQ ID NO: 4) | Sequence | Theor. mass | Exp. Mass | Error | Elution time | Abundance |
|---|---|---|---|---|---|---|---|
| D28a | 431-447 | DAFKLPPMETEEPQIFY (SEQ ID NO: 57) | 2053.97 | 2054.42 | 0.45 | 99.87 | 0.2% |
| D28b | 431-446 | DAFKLPPMETEEPQIF (SEQ ID NO: 58) | 1890.91 | 1891.28 | 0.37 | 97.02 | 18.4% |
| D28c | 431-445 | DAFKLPPMETEEPQI (SEQ ID NO 59) | 1743.84 | 1744.17 | 0.33 | 86.4 | 11.8% |
| D28d | 431-444 | DAFKLPPMETEEPQ (SEQ ID NO: 60) | 1630.70 | 1631.07 | 0.32 | 74.15 | 56.1% |
| D28e | 431-443 | DAFKLPPMETEEP (SEQ ID NO: 61) | 1502.70 | 1502.98 | 0.28 | 77.36 | 13.6% |
| D28f | 431-442 | DAFKLPPMETEE (SEQ ID NO: 62) | 1405.64 | ND | N/A | N/A | 0.0% |

TABLE 20

Analysis of C-terminal fragments from Lot HUB0701EB

| Fragment | Amino acid position (relative to SEQ ID NO: 4) | Sequence | Theor. mass | Exp. Mass | Error | Elution time | Abundance |
|---|---|---|---|---|---|---|---|
| D28a | 431-477 | DAFKLPPMETEEPQIFY (SEQ ID NO: 57) | 2053.97 | 2054.42 | 0.45 | 99.89 | 1.9% |
| D28b | 431-446 | DAFKLPPMETEEPQIF (SEQ ID NO: 58) | 1890.91 | 1891.36 | 0.45 | 96.92 | 46.7% |
| D28c | 431-445 | DAFKLPPMETEEPQI (SEQ ID NO: 59) | 1743.84 | 1744.24 | 0.40 | 85.98 | 16.7% |
| D28d | 431-444 | DAFKLPPMETEEPQ (SEQ ID NO: 60) | 1630.70 | 1631.14 | 0.39 | 73.9 | 27.8% |
| D28e | 431-443 | DAFKLPPMETEEP (SEQ ID NO: 61) | 1502.70 | 1503.03 | 0.33 | 77.02 | 6.9% |

TABLE 20-continued

Analysis of C-terminal fragments from Lot HUB0701EB

| Frag-ment | Amino acid position (relative to SEQ ID NO: 4) | Sequence | Theor. mass | Exp. Mass | Error | Elution time | Abun-dance |
|---|---|---|---|---|---|---|---|
| D28f | 431-442 | DAFKLPPMETEE (SEQ ID NO: 62) | 1405.64 | ND | N/A | N/A | 0.0% |

Example 14

Anti-Tumor Effects of PEGylated rHuPH20 and Cytotoxic Agents Following Intravenous Administration in Prostate Cancer Models The anti-tumor effect of co-administration of PEGylated rHuPH20 and the cytotoxic agents docetaxel (Taxotere®; Sanofi Aventis) and liposomal doxorubicin (Doxil®; Ortho Biotech), was assessed using a hormone refractory prostate cancer xenograft model and bone metastasis model.

A. Prostate Cancer Xenograft Model

Figure 2:
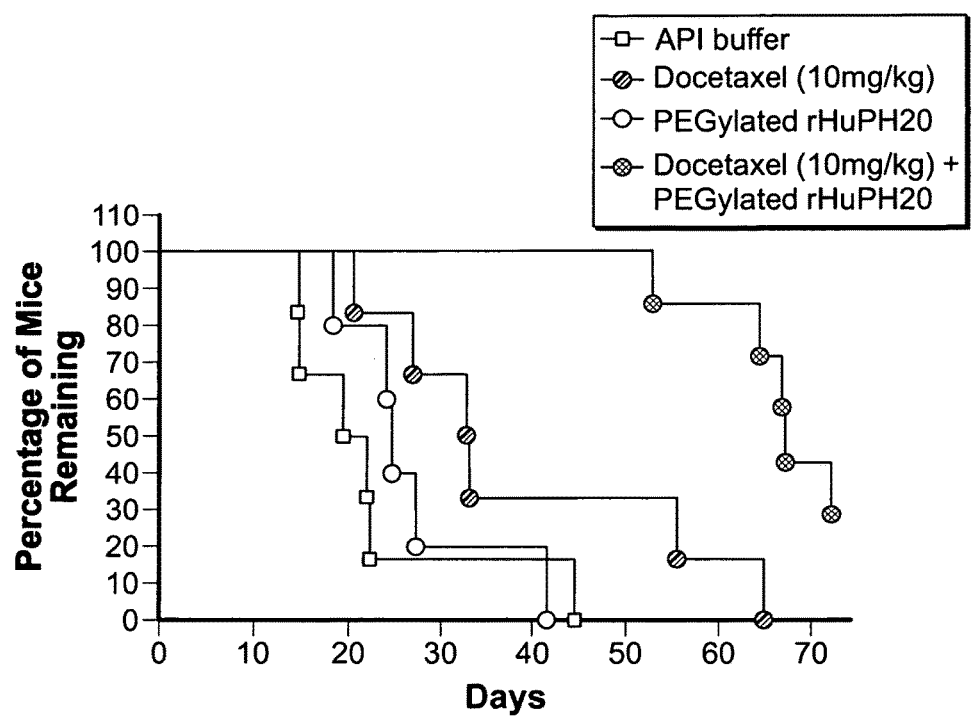
FIG. 2 depicts the percentage of mice survival to 1500 mm$^3$ tumor volume at various points following intramuscular injection of human PC3 prostate cancer cells, followed by treatment with either buffer (control mice), docetaxel, PEGylated rHuPH20 or PEGylated rHuPH20/docetaxel.

To establish PC3 peritibial hormone refractory prostate cancer xenograft model, athymic male nude mice were inoculated intramuscularly with human PC3 prostate cancer cells (1×10⁶ cells per mouse in a total volume of 0.05 mL) adjacent to the right tibial periosteum to generate tumors with a mean intersitial fluid pressure of 34±16 mmHg. The tumors were allowed to grow to a mean tumor volume of 400-500 mm³ before initiation of treatment with either cytotoxic agent/PEGylated rHuPH20, cytotoxic agent alone or PEGylated rHuPH20 alone. Tumor growth was monitored using VisualSonics Imaging Micro-ultrasound system. Mice in one group were intravenously administered 10 mg/kg Taxotere® (docetaxel) and 10,000 U/mouse PEGylated rHuPH20 on days 0 and 7. This was performed by first drawing 0.1 mL Taxotere® (docetaxel) into a syringe, followed by 0.1 mL PEGylated rHuPH20, then immediately injecting the 0.2 mL solution into the tail vain of a mouse. These mice also received additional doses of 10,000 U/mouse PEGylated rHuPH20 in 0.2 mL intravenously on days 3 and 10. A control group of mice (G2) received 10 mg/kg docetaxel Q7D×2 intravenously on days 0 and 7. Another control group of mice received 30 mg/kg docetaxel Q7D×2 intravenously on days 0 and 7. An additional control group of mice were administered 10,000 U/mouse PEGylated rHuPH20 intravenously on days 0, 3, 7 and 10. A final control group that received only API buffer also was included in the study (G1). The tumor volume was measured at various time points (FIG. 1 and Table 21) and the percentage survival to 1500 mm³ tumor volume also was observed (FIG. 2). Table 22 presents analysis of the effect of co-administration of Taxotere® (docetaxel) and PEGylated rHuPH20 on survival. The Median Survival Time (MST) (in days) was calculated by median time to 1500 mm³ tumor volume based on individual animals in each group. The % T/C is calculated by % T/C=(T/C)×100, where T is the median survival time to 1500 mm³ tumor volume in the treated group and C is the median survival time to 1500 mm³ tumor volume in the API buffer control group. By National Cancer Institute (NCI) criteria, a product with a % T/C over 125% is considered active. The Increase in Life Span (ILS) is a measure of anti-tumor activity calculated as [(T−C)/C]× 100, where (T−C) is the difference in the median day to 1500 mm³ tumor volume between the treated (T) and control (C) groups. By NCI criteria, a product with a % ILS over 25% is considered effective.

Co-administration of Taxotere® (docetaxel) and PEGylated rHuPH20 resulted in a synergistic tumor growth inhibition over a period of 73 days that was significantly superior to that of docetaxel alone at 10 mg/kg given by Q7D×2 or PEGylated rHuPH20 alone, and an increase in survival time (defined as time to reach tumor volume of 1500 mm³).

TABLE 21

Effect of co-administration of Taxotere ® (docetaxel) and PEGylated rHuPH20 on tumor volume.

| Treatment | | Tumor volume (mm3) at various days post-treatment | | | | | | | | | |
|---|---|---|---|---|---|---|---|---|---|---|---|
| | | −1 | 4 | 13 | 21 | 27 | 35 | 42 | 50 | 61 | 73 |
| API buffer | Av | 472.06 | 794.35 | 1077.2 | 1920.6 | 2549.4 | | | | | |
| (std dev) | SE | 126.29 | 176.47 | 240.71 | 711.18 | 1095.7 | | | | | |
| Taxotere ® | Av | 471.34 | 497.04 | 401.12 | 409.02 | 291.65 | 213.73 | 147.05 | 130.2 | 343.03 | 865.5 |
| (docetaxel) (30 mg/kg) alone | SE | 50.33 | 21.76 | 82.85 | 64.16 | 51.17 | 47.61 | 36.18 | 29.16 | 80.65 | 153.25 |
| Taxotere ® | Av | 470.39 | 687.27 | 869.25 | 1011.1 | 1260.7 | 1441.1 | 1552.1 | | | |
| (docetaxel) (10 mg/kg) alone | SE | 49.96 | 67.5 | 106.58 | 135.28 | 278.12 | 405.71 | 425.94 | | | |
| PEGylated | Av | 469.47 | 506.38 | 602.98 | 1213.6 | 2024.7 | | | | | |
| rHuPH20 alone | SE | 115.61 | 202 | 202.24 | 337.08 | 536.05 | | | | | |
| Taxotere ® (docetaxel) and | Av | 497 | 419.94 | 392.34 | 431.73 | 367.97 | 348.28 | 576.69 | 720.43 | 1106.2 | 1424.1 |
| | SE | 65.52 | 74.99 | 119.47 | 120.87 | 82.74 | 70.4 | 179.41 | 184.55 | 289.82 | 407.88 |

TABLE 21-continued

Effect of co-administration of Taxotere ® (docetaxel) and PEGylated rHuPH20 on tumor volume.

| Treatment | Tumor volume (mm3) at various days post-treatment | | | | | | | | | |
|---|---|---|---|---|---|---|---|---|---|---|
| | −1 | 4 | 13 | 21 | 27 | 35 | 42 | 50 | 61 | 73 |
| PEGylated rHuPH20 | | | | | | | | | | |

TABLE 22

Effect of co-administration of Taxotere ® (docetaxel) and PEGylated rHuPH20 on survival.

| Treatment | No. of Mice | Average Survival Time | MST | % T/C | % ILS | P-value* |
|---|---|---|---|---|---|---|
| Control (API Buffer) | 6 | 23.01 ± 4.52 | 20.7 | — | — | — |
| Taxotere ® (docetaxel) (10 mg/kg) alone | 6 | 38.96 ± 7.07 | 32.9 | 157 | 59 | NS vs. API control |
| PEGylated rHuPH20 alone | 5 | 27.22 ± 3.87 | 24.7 | 119 | 19 | NS vs. API control |
| Taxotere ® (docetaxel) and PEGylated rHuPH20 | 7 | 64.71 ± 3.20 | 67.2 | 319 | 225 | p = 0.0002 API control; p = 0.003 vs. Taxotere ® (docetaxel) alone |

Figure 3:
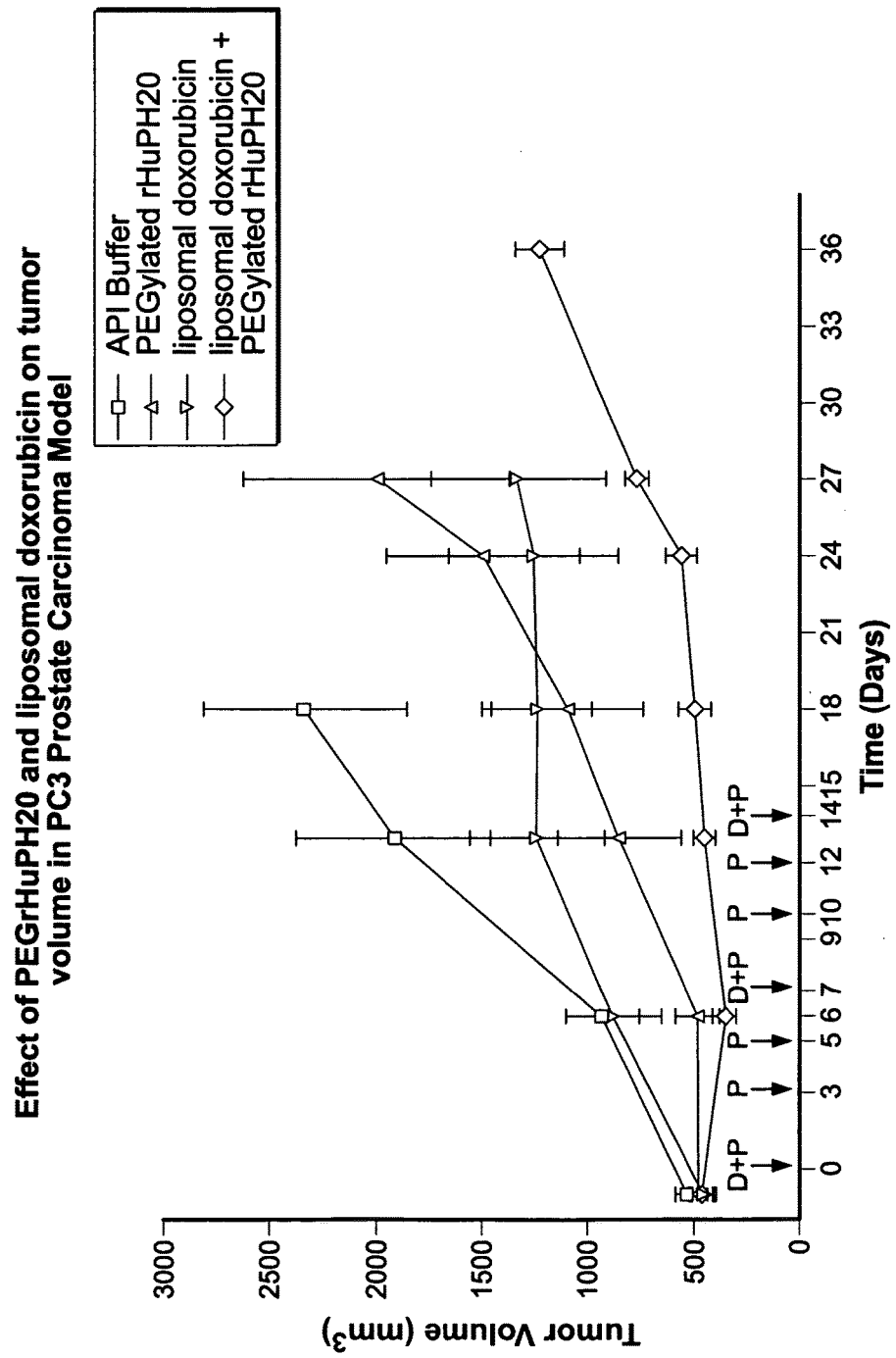
FIG. 3 depicts the tumor volume in nude mice inoculated intramuscularly with human PC3 prostate cancer cells to establish tumors (PC3 Prostate Carcinoma Model). Following inoculation, the mice were subjected to treatment regimens in which doses of either API buffer, PEGylated rHuPH20 (P), liposomal doxorubicin (D) or PEGylated rHuPH20 plus liposomal doxorubicin (D+P) were administered. The tumor volumes were measured at various time points to assess the effect of co-administration of PEGylated rHuPH20 with liposomal doxorubicin on the anti-tumor activity of liposomal doxorubicin.

To assess the anti-tumor effects of co-administration of PEGylated rHuPH20 and liposomal doxorubicin, mice harboring PC3 tumors were intravenously administered 6 mg/kg Doxil® liposomal doxorubicin and 10,000 U/mouse PEGylated rHuPH20 on Days 0, 7 and 14. This was performed by first drawing 0.1 mL Doxil® liposomal doxorubicin into a syringe, followed by 0.1 mL PEGylated rHuPH20, then immediately injecting the 0.2 mL solution into the tail vain of a mouse. These mice also received additional doses of 10,000 U/mouse PEGylated rHuPH20 in 0.2 mL on days 3, 5, 10, 12. A control group of mice were intravenously administered 6 mg/kg Doxil® liposomal doxorubicin on days 0, 7 and 14. Another control groups of mice were administered doses of 10,000 U/mouse PEGylated rHuPH20 in 0.2 mL on days 0, 3, 5, 7, 10, 12 and 14. A final control group that received only API buffer also was include in the study. Tumor volume was observed at various time points (FIG. 3 and Table 23). It was observed that the anti-tumor effects of co-administered PEGylated rHuPH20 and liposomal doxorubicin was statistically significantly superior to that of liposomal doxorubicin alone.

TABLE 23

Effect of co-administration of Doxil ® liposomal doxorubicin and PEGylated rHuPH20 on tumor volume.

| Treatment | | Tumor volume (mm3) at various days post-treatment | | | | | | |
|---|---|---|---|---|---|---|---|---|
| | | −1 | 6 | 13 | 18 | 24 | 27 | 36 |
| Control (API Buffer) | Av. | 532.95 | 926.12 | 1908.97 | 2322 | | | |
| | SE | 55.69 | 170.25 | 453.4 | 469.96 | | | |
| PEGylated rHuPH20 alone | Av. | 467.52 | 483.42 | 850.46 | 1096.05 | 1495.48 | 1996.86 | |
| | SE | 60.26 | 104.18 | 290.35 | 358.28 | 457.49 | 626.1 | |
| Doxil ® liposomal doxorubicin (10 mg/kg) alone | Av. | 454.89 | 880.01 | 1237.57 | 1236.616 | 1256.25 | 1327.96 | |
| | SE | 65.21 | 229.44 | 317.69 | 260.81 | 400.68 | 415.97 | |
| Doxil ® liposomal doxorubicin and PEGylated rHuPH20 | Av. | 452.95 | 352.28 | 451.97 | 497.52 | 561.28 | 770.27 | 1227.18 |
| | SE | 56.58 | 55.78 | 53.37 | 80.12 | 73.6 | 55.91 | 114.98 |

B. PC-3M-luc-C6 Bone Metastasis Model

The PC-3M-luc-C6 bone metastasis model was established in nude mice as described by Jenkins et al. (Clin Exp Metast (2003) 20:745-756). Due to the bioluminescence of the PC-3M-luc-C6 cells, in addition to monitoring the survival of the mice, the mice were imaged to visualize the PC-3M-luc-C6 metastases. Briefly, 7-10 week old nu/nu male mice (Charles River Laboratories) were anesthetized and injected with $3 \times 10^6$ PC-3M-luc-C6 cells (a bioluminescent human prostate carcinoma cell line) suspended in 50 μL sterile DPBS by intracardial injection on day 0. Mice were injected into the left ventricle of the heart by non-surgical means to increase the potential for metastasis from PC-3M-luc-C6 cells. The intracardiac injection of tumor cells bypasses the lungs and serves as a method to disperse cells into general circulation in order to allow seeding of metastasis in multiple tissues within an animal. A satisfactory injection into the left ventricle was detectable within minutes by bioluminescent imaging (BLI) and was identified by an immediate but transient systemic bioluminescence over the entire animal, as indicated by complete blue signal BLI of mice. An unsuccessful implantation produced a more localized signal generally isolated and sustained over time solely within the thoracic region of the animal. The animals that showed high bioluminescent signal in the chest on days 0 and 11 were excluded from the study. Mice with successful intra-cardiac injection of PC-3Mluc-C6 cells on day 0 (n=10–13 mice/Grp) were imaged twice a week for up to four weeks and subsequently followed up for survival till day 49 and beyond that time point. In all the mice, early indications of metastasis to various tissues were observed within fourteen days after injection of cells. The observed patterns of metastasis indicated lesions developing in the thorax, jaw and/or leg of mice.

On day 14, the mice were subjected to one of several treatment regimens. A set of control mice was administered API buffer (10 mM Hepes and 130 mM NaCl, pH 7.0) only on days 14, 16, 18, 21, 23, 25, 28, 30, and 32. Two other sets of mice received 30 mg/kg Taxotere® (docetaxel) Q7Dx2 on days 14 and 21, or 10 mg/kg Taxotere® (docetaxel) Q7Dx3 on days 14, 21 and 28, respectively. Another group of mice were administered 10,000 U/mouse PEGylated rHuPH20 intravenously on days 14, 16, 18, 21, 23, 25, 28, 30, 32 and 35. Two other groups of mice received either admixed PEGylated rHuPH20/Taxotere® (docetaxel) or sequentially administered PEGylated rHuPH20 then Taxotere® (docetaxel). The first of these groups were intravenously administered 10 mg/kg Taxotere® (docetaxel) and 10,000 U/mouse PEGylated rHuPH20 on days 14, 21 and 28 post injection. This was performed by first drawing 0.1 mL Taxotere® (docetaxel) into a syringe, followed by 0.1 mL PEGylated rHuPH20, then immediately injecting the 0.2 mL solution into the tail vain of a mouse. These mice also received additional doses of 10,000 U/mouse PEGylated rHuPH20 in 0.2 mL intravenously on days 16, 18, 23, 25, 30 and 32. The second of these groups received the same dosing, but instead of an admixture of 10 mg/kg Taxotere® (docetaxel)/10,000 U PEGylated rHuPH20, the 10,000 Unit PEGylated rHuPH20 dose was administered two hours prior to administration of the 10 mg/kg Taxotere® (docetaxel) dose.

The mice were imaged as described previously (Jenkins et al. (2003) Clin Exp Metast 20:745-756) using an IVIS® Imaging System (Xenogen) and analyzed using Living Image® software (Xenogen) on days 0, 11, 15, 18, 22, 25 and 29 to visualize the bioluminescent PC-3M-luc-C6 metastases. The initial signals at days 0 and 11 were confirmed by subsequent images till day 29, and nearly all metastatic sites showed a gradual increase in bioluminescence over time. The in vivo bioluminescent signal from the jaw region of mice corresponds to micrometastases in the dental pulp, mandible or cervical lymph nodes. Lower limb in vivo signals corresponded to metastatic lesions identified in the tibia or femur leg bones. The thoracic signals that are observed in vivo are associated with residual tumor cells that had seeded into the heart, lung or the pleural surface of the chest cavity. Mice with images indicating a successful systemic injection on day 0 and showing in vivo evidence of metastasis by day 29 were included in the analysis of the treatment groups.

Taxotere® (docetaxel) administered intravenously at 30 mg/kg on Days 14 and 21 represents the highest dose level at MTD (maximum tolerated dose). Images taken from day 11 to day 29 indicate that the drug has significant inhibitory effect at all metastatic sites in the treated mice. The images on Day 11 show mice with representative metastatic patterns that gradually disappear with time as indicated by the decrease in bioluminescence intensity detectable at day 29 in the 10 out of 11 mice remaining alive at Day 29. A similar trend, but to a lesser extent, of luminescence decrease was observed in the images of 10 mg/kg Taxotere® (docetaxel) treated mice, with 9 out of 12 surviving animals at day 29 post-tumor cell injection. In contrast, control PEGylated rHuPH20 treated animals showed evidence of a subsequent relapse in whole animal bioluminescence, indicated by a rebound signal at day 29 as seen from the images of 6 surviving mice. Images at day 29 of mice that received admixed PEGylated rHuPH20/Taxotere® (docetaxel) and mice that received sequentially administered PEGylated rHuPH20 and Taxotere® (docetaxel) demonstrated unchanged to reduced levels of BLI signal amount and intensity, indicating stabilization of tumor dissemination to bone sites. In particular, four mice that received sequential doses of PEGylated rHuPH20 and Taxotere® (docetaxel) appeared to have become completely signal free on day 29, indicating possible cures or long term survivors effects.

The survival rates of each group of mice 49 days after intracardial injection of PC-3M-luc-C6 are presented in Table 24. It was observed that co-administration of 10,000 units PEGylated rHuPH20 and 10 mg/kg Taxotere® (docetaxel) resulted in greater anti-tumor activity than treatment with 10 mg/kg Taxotere® (docetaxel) alone.

TABLE 24

Effect of co-administration of PEGylated rHuPH20 and Taxotere ® (docetaxel) of survival in a PC-3M-luc-C6 bone metastasis model

| Treatment | Number of Animals | No. of animals alive at day 49 | % survival |
|---|---|---|---|
| API buffer | 13 | 3 | 23.08 |
| Taxotere ® (docetaxel) (30 mg/kg) | 11 | 10 | 90.91 |
| Taxotere ® (docetaxel) (10 mg/kg) | 12 | 9 | 75.00 |
| PEGylated rHuPH20 | 10 | 4 | 40.00 |
| PEGylated rHuPH20 and Taxotere ® (docetaxel) (admixed) | 13 | 13 | 100 |
| PEGylated rHuPH20 and Taxotere ® (docetaxel) (sequentially 2 hrs apart) | 11 | 10 | 90.91 |

Example 15

Toxicity Studies

PEGylated rHuPH20 Alone and in Combination with Docetaxel

For a toxicity study of PEGylated rHuPH20 alone and in combination with Taxotere® (docetaxel), nude mice were administered various doses of PEGylated rHuPH20 with 10 mg/kg Taxotere® (docetaxel). Control groups of mice receiving PEGylated rHuPH20 alone, Taxotere® (docetaxel) alone or API buffer alone also were included in the study. Table 25 sets forth the treatment regimen for each group of mice. For toxicity studies, body weights and in-life observation were monitored over the course of study for up to 26 days. Complete blood chemistry with differential and serum clinical chemistry was assessed on whole blood and serum samples by an external Contract Research Organization, BioQuant Inc (San Diego, Calif.).

Figure 4:
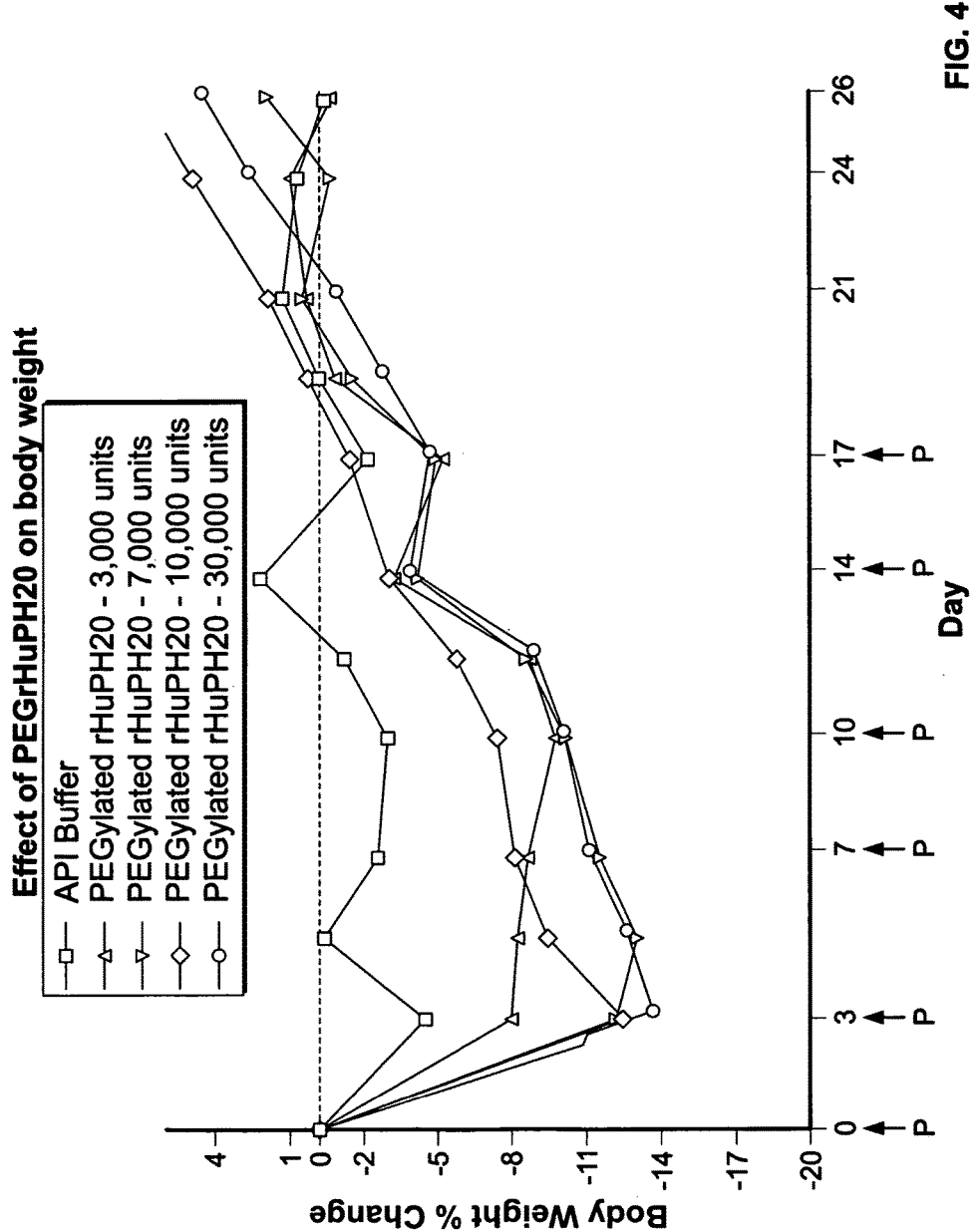
FIG. 4 depicts the body weight change (in percentage) following administration of 3000, 7000, 10000, or 30000 Units of PEGylated rHuPH20 (P) on days 0, 3, 7, 10, 14, 17, 21, 24.
Figure 5:
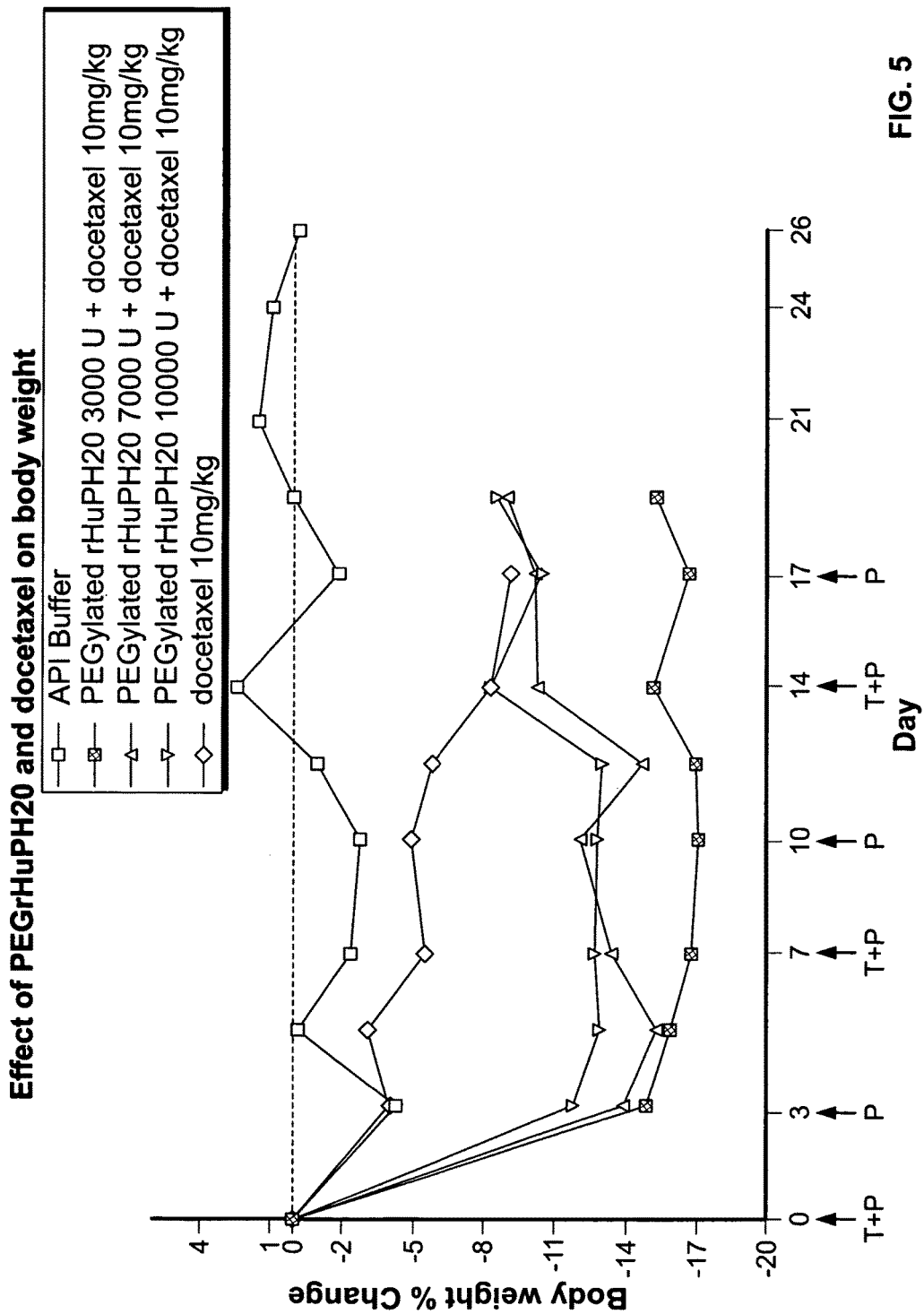
FIG. 5 depicts the body weight change (in percentage) following co-administration of 10 mg/kg docetaxel with either 3000, 7000, or 10000 Units of PEGylated rHuPH20 (T+P) to nude mice on days 0, 7, 14 and 21. These mice also received either 3000, 7000, or 10000 Units of PEGylated rHuPH20 on days 3, 10, 17 and 24. The body weight change of mice that received only API buffer or 10 mg/kg docetaxel also are depicted.
Figure 6:
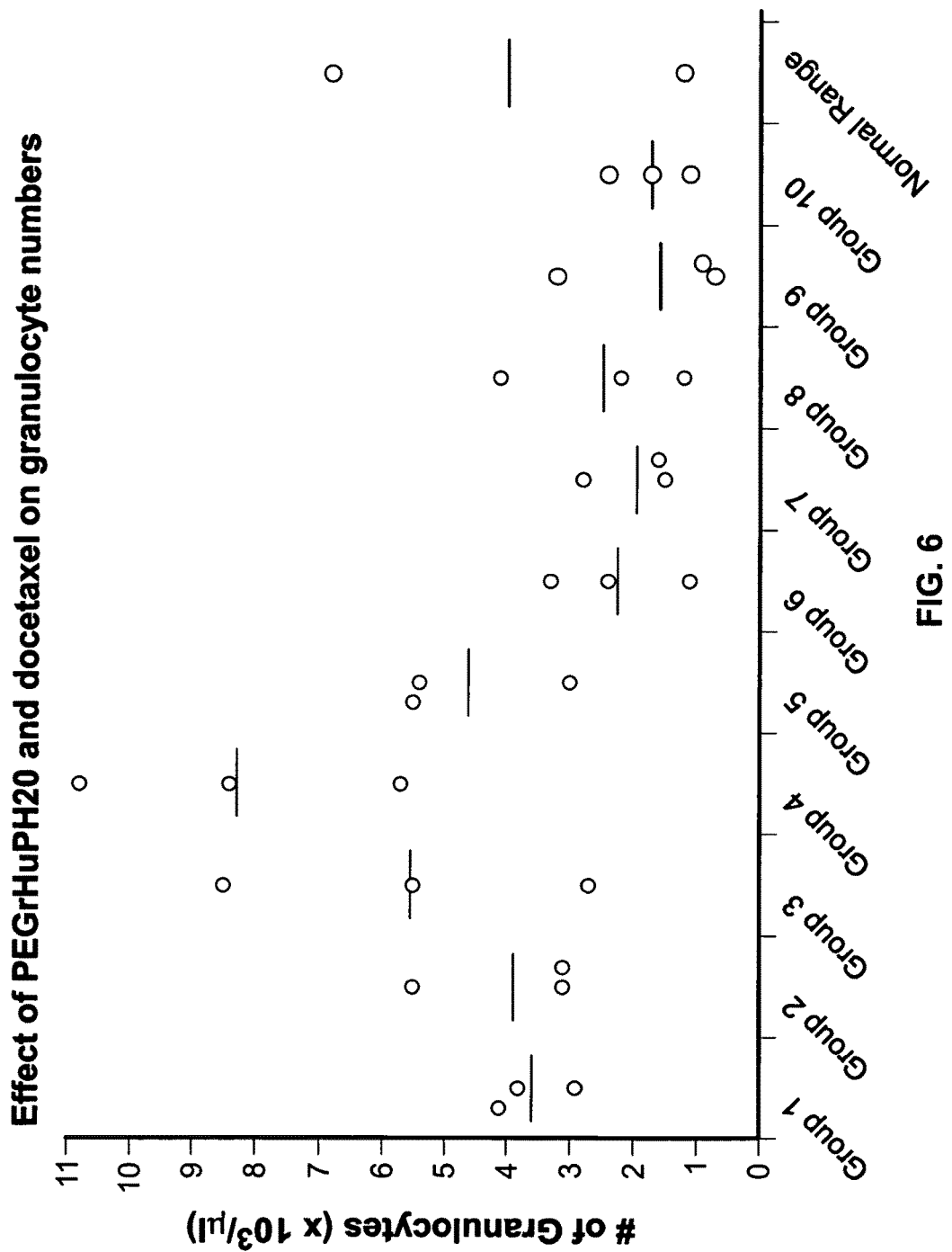
FIG. 6 depicts the number of granulocytes in the blood of nude mice administered various doses of either PEGylated rHuPH20 with 10 mg/kg Taxotere® (docetaxel), PEGylated rHuPH20 alone, Taxotere® (docetaxel) alone or API buffer alone. Mice in group 1 received API buffer on days 0, 3, 7, 10, 14, 17, 21, 24; Groups 2-5 received PEGylated rHuPH20 at a dose of either 3000, 7000, 10000 or 30000 units/mouse, respectively, on days 0, 3, 7, 10, 14, 17, 21, 24; Groups 6-8 were co-administered Taxotere® (docetaxel) with either 3000, 7000, 10000 units/mouse PEGylated rHuPH20, respectively, on days 0, 7, 14, 21 and then PEGylated rHuPH20 alone on days 3, 10, 17, 24; Groups 9 and 10 received 10 mg/kg Taxotere® (docetaxel) or 30 mg/kg Taxotere® (docetaxel), respectively, on days 0, 7 and 14. The number of granulocytes in the blood at various time points was then assessed.
Figure 7:
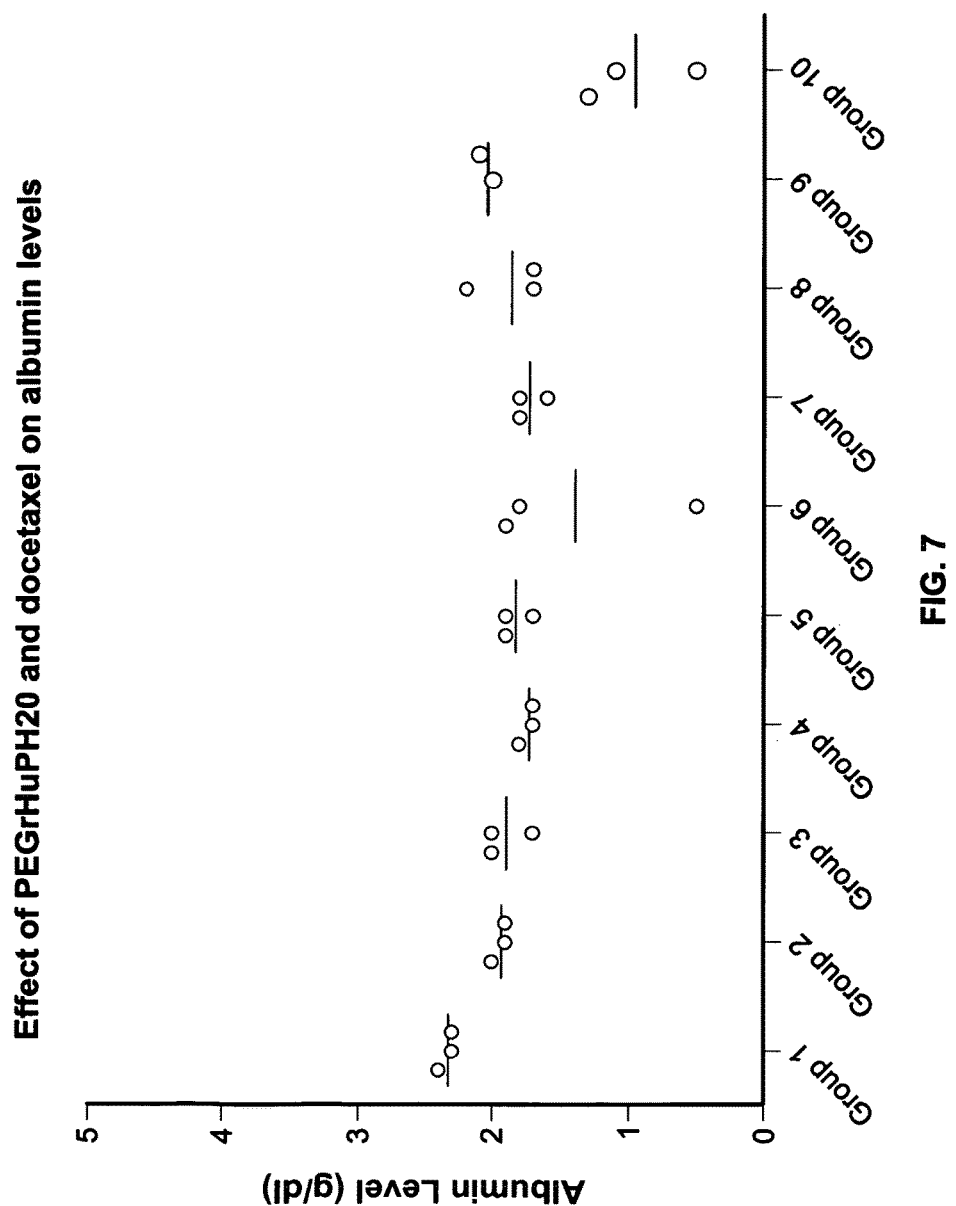
FIG. 7 depicts the albumin levels in the serum of mice nude mice administered various doses of either PEGylated rHuPH20 with 10 mg/kg Taxotere® (docetaxel), PEGylated rHuPH20 alone, Taxotere® (docetaxel) alone or API buffer alone. Mice in group 1 received API buffer on days 0, 3, 7, 10, 14, 17, 21, 24; Groups 2-5 received PEGylated rHuPH20 at a dose of either 3000, 7000, 10000 or 30000 units/mouse, respectively, on days 0, 3, 7, 10, 14, 17, 21, 24; Groups 6-8 were co-administered Taxotere® (docetaxel) with either 3000, 7000, 10000 units/mouse PEGylated rHuPH20, respectively, on days 0, 7, 14, 21 and then PEGylated rHuPH20 alone on days 3, 10, 17, 24; Groups 9 and 10 received 10 mg/kg Taxotere® (docetaxel) or 30 mg/kg Taxotere® (docetaxel), respectively, on days 0, 7 and 14.

Tables 26 and 27 and FIGS. 4 and 5 set forth the changes in body weight following administration of PEGylated rHuPH20 alone, PEGylated rHuPH20/Taxotere® (docetaxel) and Taxotere® (docetaxel) alone. Table 27 and FIG. 6 set forth the number of granulocytes in the blood of mice administered PEGylated rHuPH20 alone, PEGylated rHuPH20/Taxotere® (docetaxel) and Taxotere® (docetaxel) alone, and Table 28 and FIG. 7 set forth the serum albumin levels in mice administered PEGylated rHuPH20 alone, PEGylated rHuPH20/Taxotere® (docetaxel) and Taxotere® (docetaxel) alone. The normal range for number of granulocytes in the blood of healthy mice is $1.2\text{-}6.8 \times 10^3$ cells/µL, and normal serum albumin ranges are 2.5-4.8 g/dL. It was observed that co-administration of docetaxel and PEGylated rHuPH20 was well tolerated with no significant increase in neutropenia (as indicated by no significant reduction in granulocytes) and was better tolerated compared to docetaxel treatment alone at maximum tolerated dose (MTD) of 30 mg/kg. Administration of PEGylated rHuPH20 alone at doses of up to 30,000 U/mouse also was well tolerated.

TABLE 25

Treatment regime for PEGylated rHuPH20/Taxotere toxicity study.

| Group No. | Dose Route | Dose | Dose Volume (mL/mouse) | Dose Frequency |
|---|---|---|---|---|
| 1 | IV | API Buffer (control group) | 0.3 | Study days 0, 3, 7, 10, 14, 17, 21, 24 |
| 2 | IV | PEGylated rHuPH20 (3,000 U/mouse) | 0.3 | Study days 0, 3, 7, 10, 14, 17, 21, 24 |
| 3 | IV | PEGylated rHuPH20 (7,000 U/mouse) | 0.3 | Study days 0, 3, 7, 10, 14, 17, 21, 24 |
| 4 | IV | PEGylated rHuPH20 (10,000 U/mouse) | 0.3 | Study days 0, 3, 7, 10, 14, 17, 21, 24 |
| 5 | IV | PEGylated rHuPH20 (30,000 U/mouse) | 0.3 | Study days 0, 3, 7, 10, 14, 17, 21, 24 |
| 6 | IV | PEGylated rHuPH20 (3,000 U/mouse) + Taxotere ® (docetaxel) (10 mg/kg) | 0.3 | Study days 0, 7, 14, 21 plus PEG alone on days 3, 10, 17, 24 |
| 7 | IV | PEGylated rHuPH20 (7,000 U/mouse) + Taxotere ® (docetaxel) (10 mg/kg) | 0.3 | Study days 0, 7, 14, 21 plus PEG alone on days 3, 10, 17, 24 |
| 8 | IV | PEGylated rHuPH20 (10,000 U/mouse) + Taxotere ® (docetaxel) (10 mg/kg) | 0.3 | Study days 0, 7, 14, 21 plus PEG alone on days 3, 10, 17, 24 |
| 9 | IV | Taxotere ® (docetaxel) (10 mg/kg) | 0.3 | Study days 0, 7, 14 plus API buffer alone on days 3, 10, 17 |
| 10 | IV | Taxotere ® (docetaxel) (30 mg/kg) | 0.3 | Study days 0, 7, 14 plus API buffer alone on days 3, 10, 17 |

TABLE 26

Change in body weight following administration of PEGylated rHuPH20 alone.

| | Percentage change in body weight | | | | | | | | |
|---|---|---|---|---|---|---|---|---|---|
| | API Buffer (control group) | | PEGylated rHuPH20 (3,000 U/mouse) | | PEGylated rHuPH20 (7,000 U/mouse) | | PEGylated rHuPH20 (10,000 U/mouse) | | PEGylated rHuPH20 (30,000 U/mouse) | |
| Day | Av. | SE | Av. | SE | Av. | SE | Av. | SE | Av. | SE |
| 3 | −4.3 | 1.4 | −7.8 | 2.1 | −12 | 2 | −12.2 | 0.7 | −13.7 | 1.3 |
| 5 | −0.2 | 1.7 | −8 | 1 | −12.8 | 2.9 | −9.2 | 0.8 | −12.6 | 1.4 |
| 7 | −2.4 | 1.5 | −8.4 | 1.5 | −11.3 | 3.4 | −7.9 | 1 | −11.1 | 1.8 |
| 10 | −2.8 | 0.8 | −9.5 | 1.2 | −9.9 | 3.2 | −7.2 | 1.1 | −10.1 | 2.4 |
| 12 | −1 | 1 | −8.5 | 1 | −8.4 | 2.7 | −5.6 | 2.3 | −8.9 | 2.1 |
| 14 | 2.4 | 1.5 | −3 | 1.2 | −3.9 | 2.3 | −2.8 | 4.2 | −3.9 | 2.3 |
| 17 | −1.9 | 1.1 | −5 | 0.7 | −4.7 | 2.4 | −1.2 | 8 | −4.7 | 2.2 |
| 19 | 0 | 1.7 | −0.6 | 1 | −1.3 | 3 | 0.5 | 0.8 | −2.8 | 2.9 |
| 21 | 1.5 | 2.2 | 0.5 | 1.5 | 0.7 | 2.5 | 2.1 | 2.5 | −0.9 | 3 |
| 24 | 0.9 | 1.9 | 1.2 | 2 | −0.4 | 1.5 | 5.1 | 2.9 | 2.6 | 2.4 |
| 26 | −0.2 | 1.9 | −0.4 | 1.5 | 2.1 | 1.2 | 6.7 | 5.3 | 4.5 | 3.2 |

TABLE 27

Change in body weight following administration of PEGylated rHuPH20/Taxotere ® (docetaxel) or Taxotere ® (docetaxel) alone.

Percentage change in body weight

| Day | API Buffer (control group) Av. | SE | PEGylated rHuPH20 (3,000 U/mouse) + Taxotere ® (docetaxel) (10 mg/kg) Av. | SE | PEGylated rHuPH20 (7,000 U/mouse) + Taxotere ® (docetaxel) (10 mg/kg) Av. | SE | PEGylated rHuPH20 (10,000 U/mouse) + Taxotere ® (docetaxel) (10 mg/kg) Av. | SE | Taxotere ® (docetaxel) (10 mg/kg) Av. | SE |
|---|---|---|---|---|---|---|---|---|---|---|
| 3 | -4.3 | 1.4 | -14.9 | 3 | -13.9 | 2.6 | -11.8 | 1.2 | -4 | 0.6 |
| 5 | -0.2 | 1.7 | -15.9 | 3 | -15.3 | 3.3 | -12.9 | 1.3 | -3.1 | 1.5 |
| 7 | -2.4 | 1.5 | -16.8 | 2.8 | -13.4 | 1.3 | -12.7 | 0.6 | -5.5 | 1.8 |
| 10 | -2.8 | 0.8 | -17.1 | 2.2 | -12.1 | 2.5 | -12.8 | 1.1 | -4.9 | 2 |
| 12 | -1 | 1 | -17 | 2.2 | -14.7 | 3.6 | -13 | 1.3 | -5.8 | 2.2 |
| 14 | 2.4 | 1.5 | -15.2 | 3.5 | -10.3 | 4 | -8.4 | 0.7 | | |
| 17 | -1.9 | 1.1 | -16.7 | 3.1 | -10.2 | 3.7 | -10.5 | 1.2 | | |
| 19 | 0 | 1.7 | -15.3 | 2.3 | -9 | 3.6 | -8.6 | 2.2 | | |
| 21 | 1.5 | 2.2 | | | | | | | | |
| 24 | 0.9 | 1.9 | | | | | | | | |
| 26 | -0.2 | 1.9 | | | | | | | | |

TABLE 28

Number of granulocyte in the blood of mice following administration of PEGylated rHuPH20/Taxotere ® (docetaxel) or Taxotere ® (docetaxel) alone.

| Treatment | Number of granulocytes in the blood ($1 \times 10^3/\mu L$) | | | |
|---|---|---|---|---|
| | Mouse 1 | Mouse 2 | Mouse 3 | Mean |
| API Buffer | 2.9 | 4.1 | 3.8 | 3.6 |
| PEG rHuPH20 (3,000) | 3.1 | 3.1 | 5.5 | 3.9 |
| PEG rHuPH20 (7,000 U) | 5.5 | 2.7 | 8.5 | 5.6 |
| PEGrHuPH20 (10,000 U) | 5.7 | 8.4 | 10.8 | 8.3 |
| PEG rHuPH20 (30,000 U) | 5.4 | 3 | 5.5 | 4.6 |
| PEGrHuPH20 (3,000 U) + Taxotere ® (docetaxel) | 3.3 | 2.4 | 1.1 | 2.3 |
| PEGrHuPH20 (7,000 U) + Taxotere ® (docetaxel) | 1.6 | 1.5 | 2.8 | 1.9 |
| PEG rHuPH20 (10,000 U) + Taxotere ® (docetaxel) | 4.1 | 1.2 | 2.2 | 2.5 |
| Taxotere ® (docetaxel) (10 mg/kg) | 3.2 | 0.9 | 0.7 | 1.6 |
| Taxotere ® (docetaxel) (30 mg/kg) | 1.1 | 2.4 | 1.7 | 1.7 |

TABLE 29

Albumin levels in mice following administration of PEGylated rHuPH20/Taxotere ® (docetaxel) or Taxotere ® (docetaxel) alone.

| Treatment | Albumin levels (g/dL) | | | |
|---|---|---|---|---|
| | Mouse 1 | Mouse 2 | Mouse 3 | Mean |
| API Buffer | 2.4 | 2.3 | 2.3 | 2.3 |
| PEG rHuPH20 (3,000) | 1.9 | 2 | 1.9 | 1.9 |
| PEG rHuPH20 (7,000 U) | 2 | 1.7 | 2 | 1.9 |
| PEGrHuPH20 (10,000 U) | 1.7 | 1.8 | 1.7 | 1.7 |
| PEG rHuPH20 (30,000 U) | 1.9 | 1.9 | 1.7 | 1.8 |
| PEGrHuPH20 (3,000 U) + Taxotere ® (docetaxel) | 0.5 | 1.8 | 1.9 | 1.4 |
| PEGrHuPH20 (7,000 U) + Taxotere ® (docetaxel) | 1.6 | 1.8 | 1.8 | 1.7 |
| PEG rHuPH20 (10,000 U) + Taxotere ® (docetaxel) | 1.7 | 2.2 | 1.7 | 1.9 |
| Taxotere ® (docetaxel) (10 mg/kg) | 2.1 | 2 | | 2.0 |
| Taxotere ® (docetaxel) (30 mg/kg) | 1.3 | 1.1 | 0.5 | 1 |

Example 16

Antitumor Activity of PEGylated rHuPH20 Alone in PC3 Xenograft Model

To demonstrate antitumor activity of PEGylated rHuPH20 alone, the PC3 xenograft model described in the Examples above was used to measure tumor growth following repeated and sustained administration.

A. Repeated Intravenous Administration of PEGylated rHuPH20 Produces Anti-Tumor Effects in the PC3 Human Prostate Cancer Model.

The PC3 human prostate cancer model was generated as described above. Athymic male nude mice were inoculated intramuscularly (IM) with human PC3 prostate cancer cells (1×10⁶ cells per mouse in a total volume of 0.05 mL) adjacent to the right tibial periosteum to generate tumors with high interstitial fluid pressure. Tumors were allowed to grow to a mean tumor volume of 400-500 mm³ before initiation of intravenous treatment with control vehicle and varying enzymatic unit (U) amounts of PEGPH20, as follows. Five groups of mice were used. Control vehicle was administered to group 1 (eleven animals); 1000 U PEGylated rHuPH20 was administered to each animal in group 2 (eight animals); 3,000 U PEGylated rHuPH20 was administered to each animal in group 3 (eight animals); 10,000 U PEGylated rHuPH20 was administered to each animal in group 4 (eight animals); and 30,000 U PEGylated rHuPH20 was administered to each animal in group 5 (eleven animals). PEGylated rHuPH20 or control vehicle was administered to each animal, three times per week (Q3W), every other day (EOD), Monday, Wednesday and Friday, for a total of eight doses: one dose on day 0, and then on day 3, 5, 7, 10, 12, 14 and 17.

Figure 8:
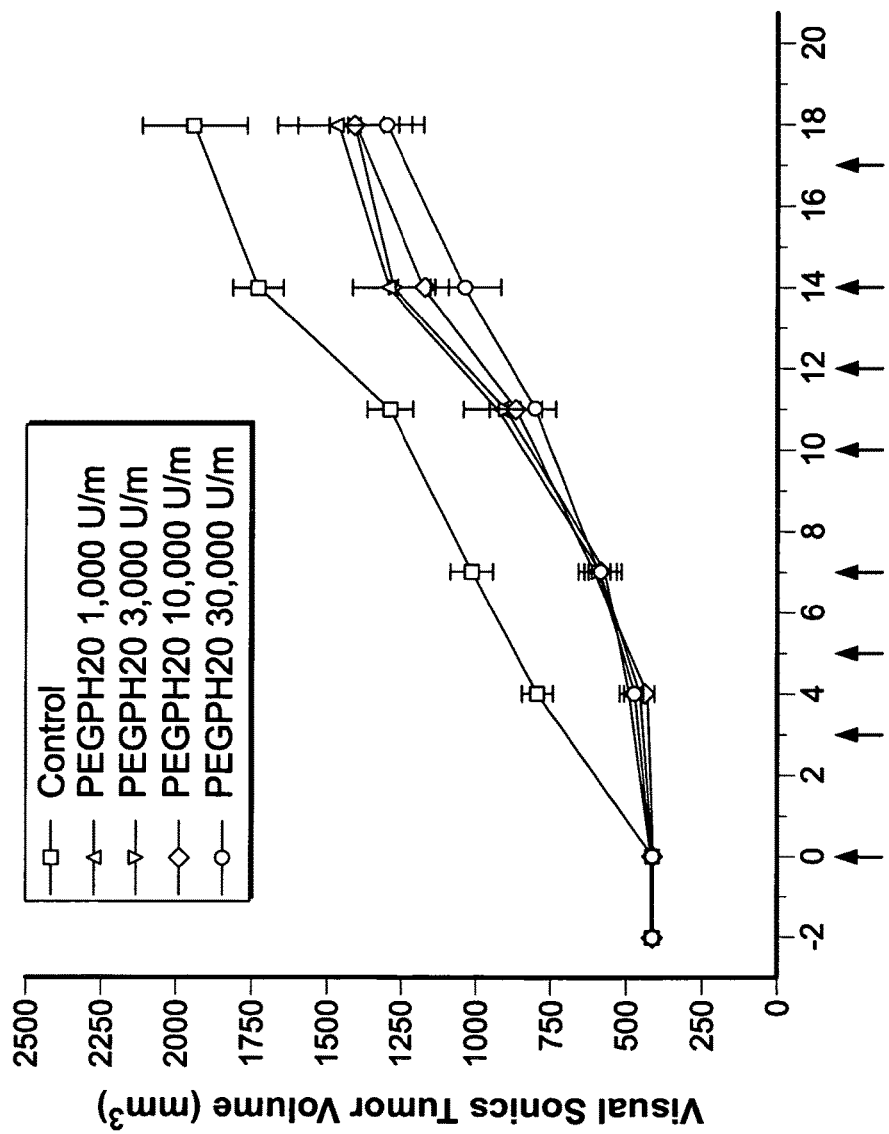
FIG. 8 depicts the effects of repeated administration of PEGylated rHuPH20, alone, in the HA-rich human prostate tumor xenograft model, PC3. As described in Example 16A, mice were injected on days 0, 3, 5, 7, 10, 12, 14 and 17, with control buffer and various amounts (enzymatic units (U)) of PEGylated HuPH20. tumor volume (mm$^3$) was measured over the course of the study in each group of animals, at days 2, 4, 7, 11, 14 and 18 by capturing images using the Visual Sonics® ultrasound system and using an ultrasound imaging software program. These results also are set forth in Table 29.
Figure 9A:
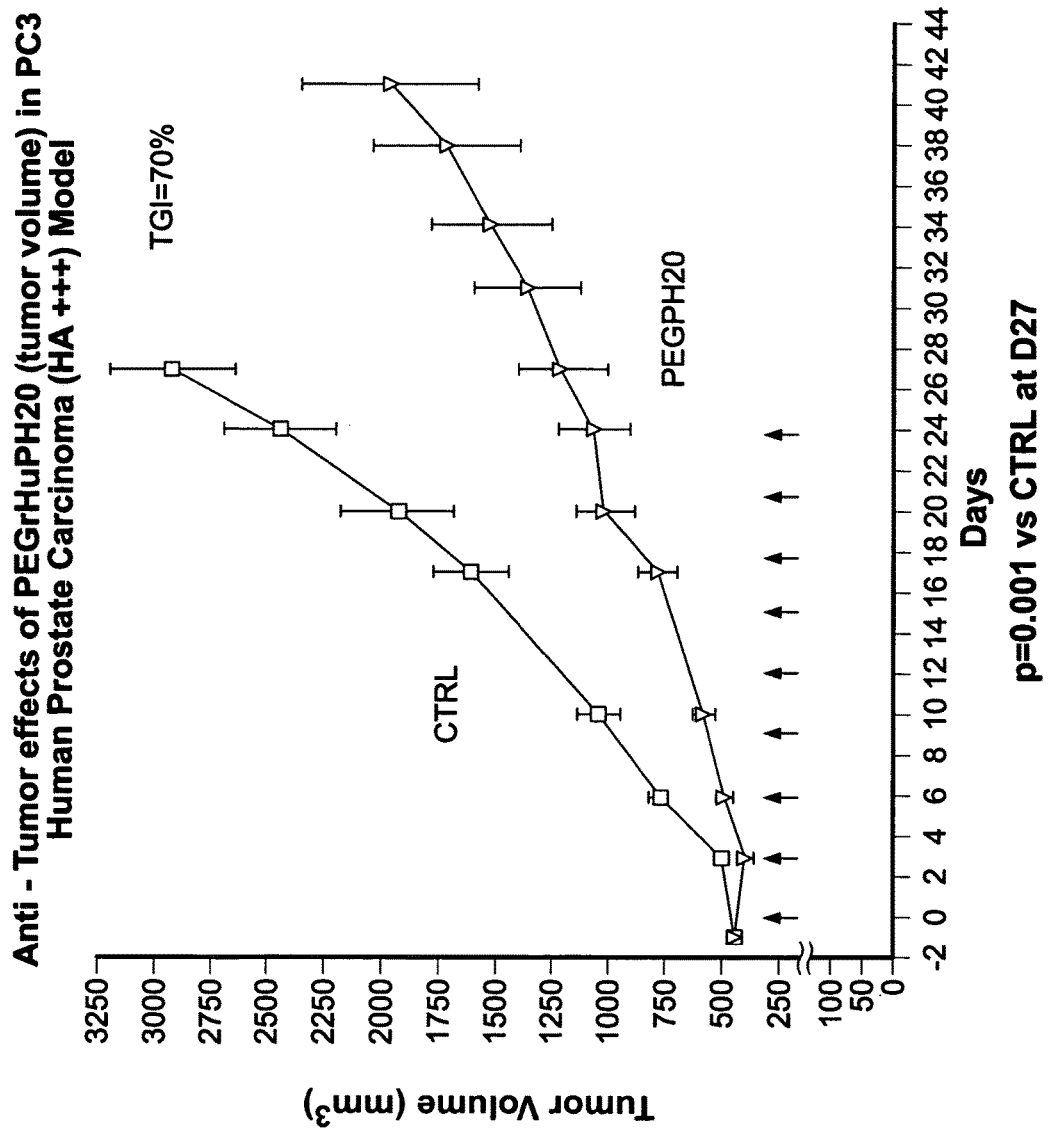
FIG. 9 depicts the tumor volume and percent survival in three different tumor models (PC3, 4T1-GFP, Mat LyLu), having varying degrees of hyaluronan (HA) tumor expression (+++, ++ and +), following administration of API buffer or 3000 U PEGylated rHuPH20. The results are described in Example 17C, and also are set forth in Tables 33-37. As noted in Example 17, the effects were assessed in each model by determining the percentage of "surviving" animals at each time-point in each group. For this study, a tumor volume of greater than or equal to 1500 mm$^3$ was selected as an endpoint, which was considered analogous to a moribund (non-surviving) state and animals with tumor volumes below 1500 mm$^3$ were considered surviving, while animals with tumor volumes 1500 mm$^3$ or greater were considered morbid.
Figure 9B:
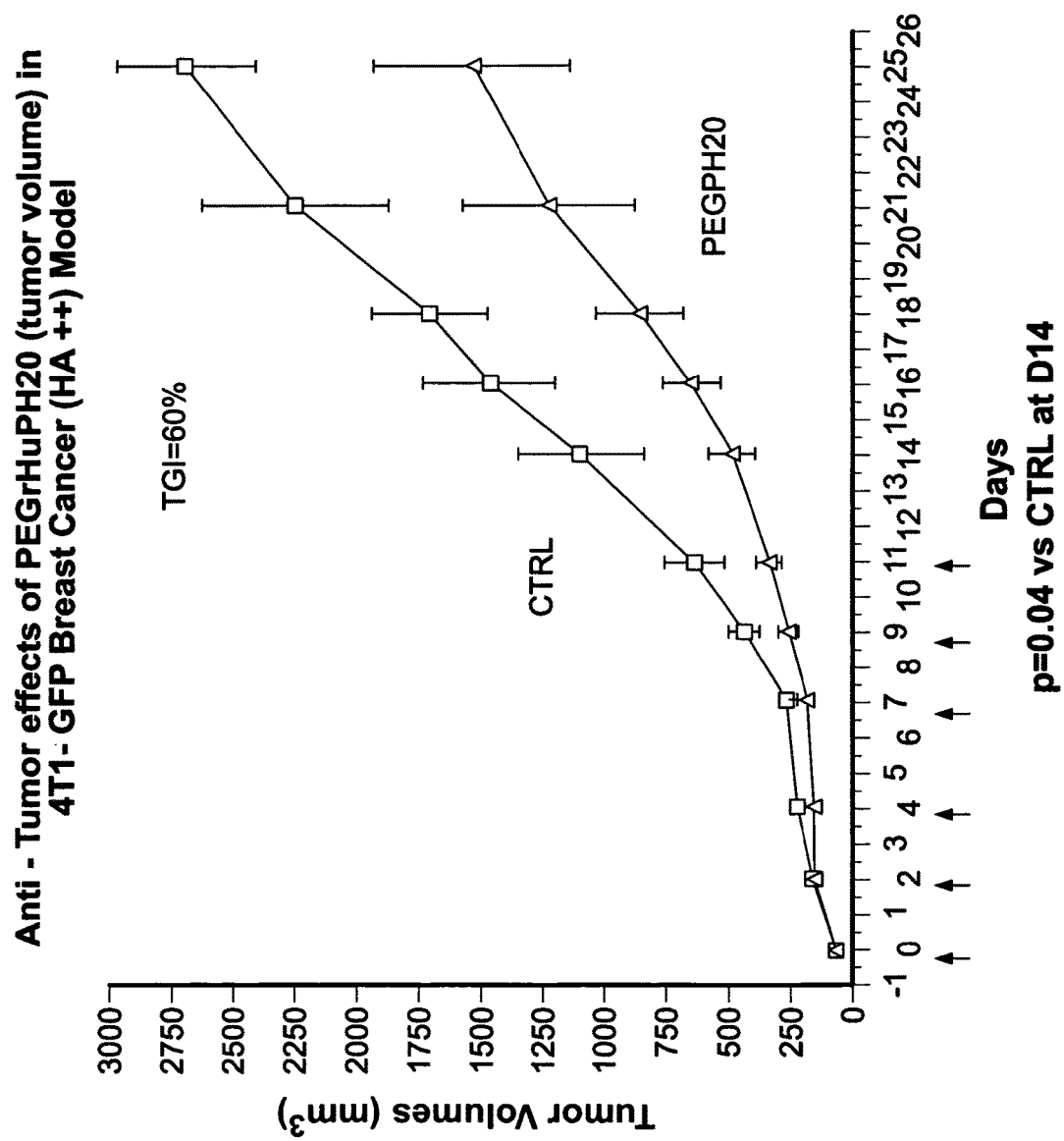
Figure 9C:
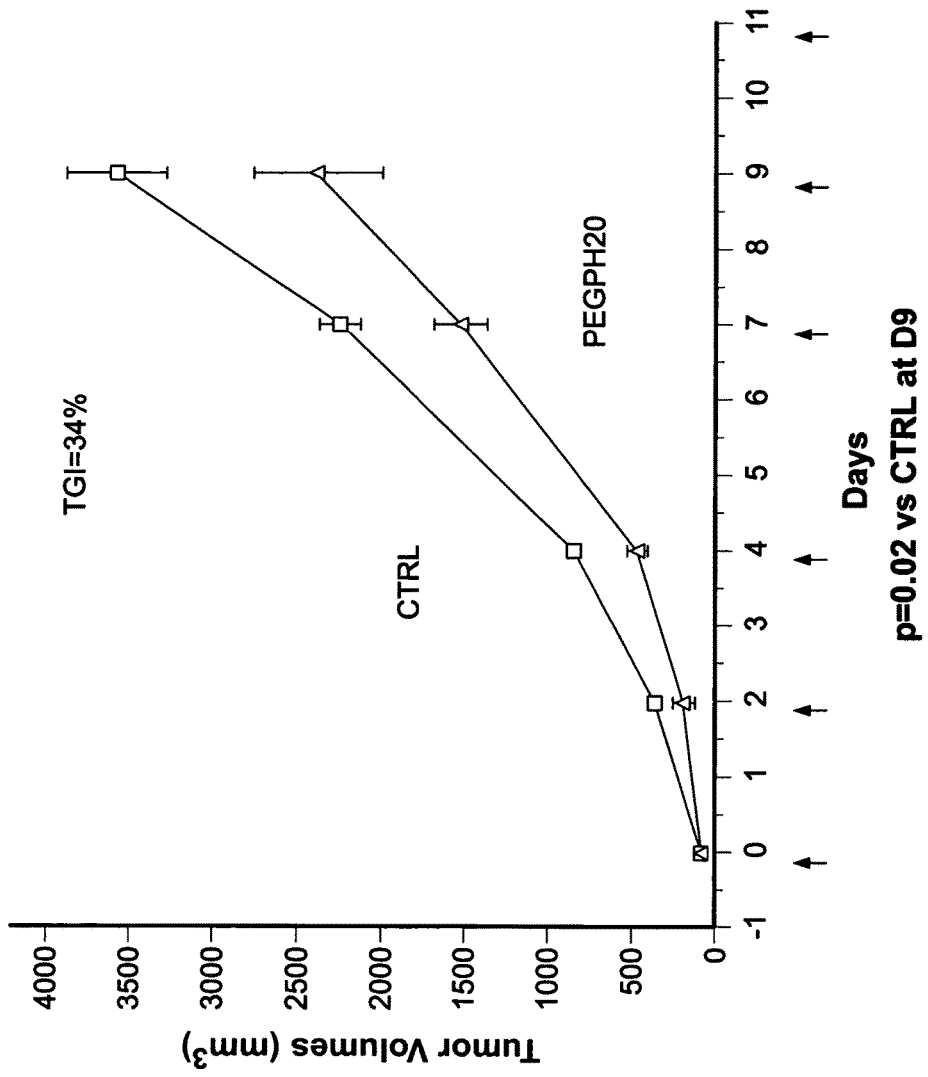
Figure 9D:
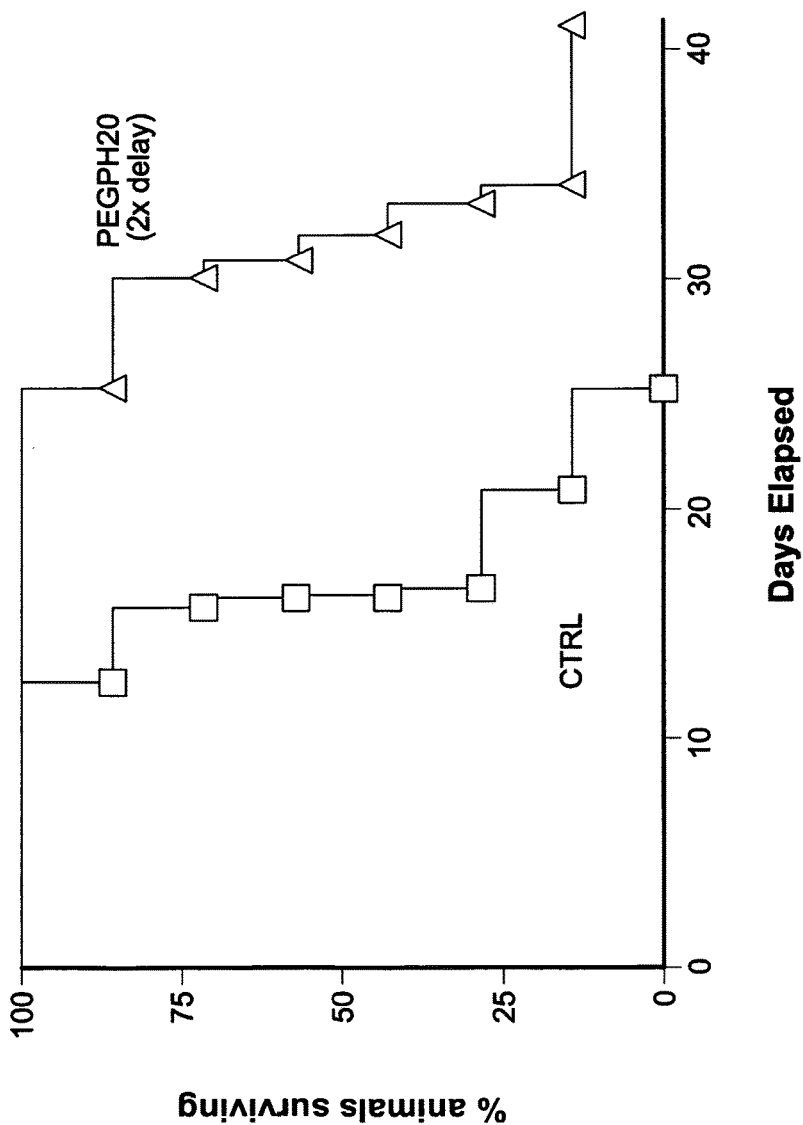
Figure 9E:
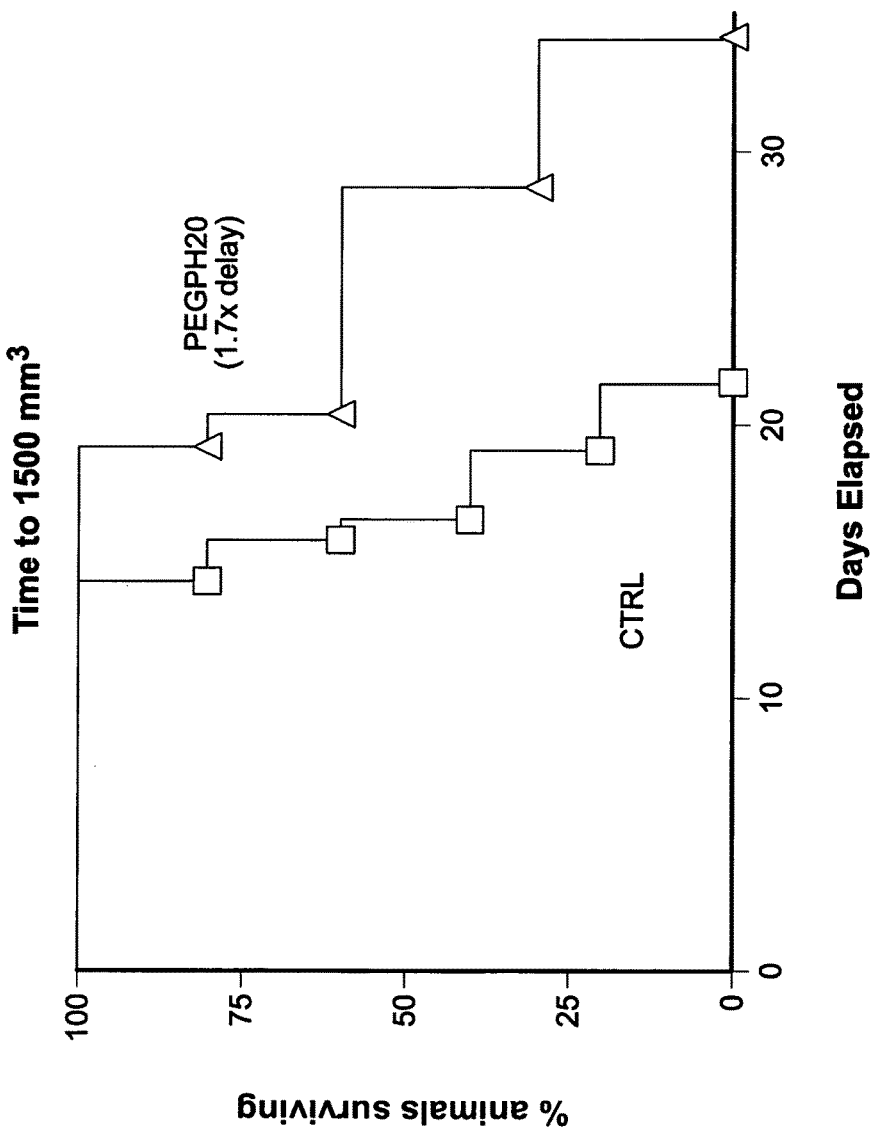
Figure 9F:
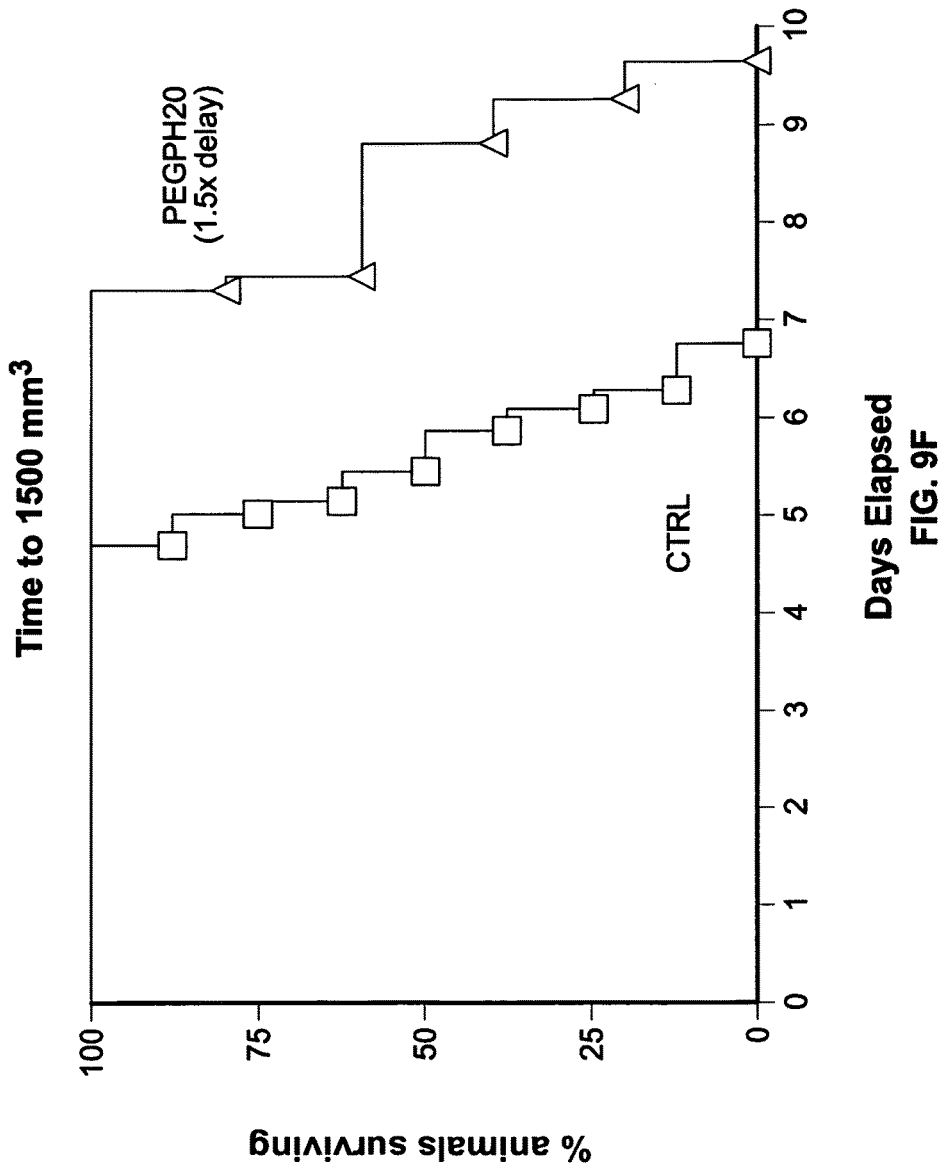

Tumor volume (mm³) was measured over the course of the study in each group of animals, at days 2, 4, 7, 11, 14 and 18 by capturing images using the VisualSonic ultrasound system and using an ultrasound imaging software program. The data are presented in FIG. 8 and in Table 30, below. Error bars in FIG. 8 represent standard error, which also is listed in Table 30. The results demonstrated that each dose of repeated intravenous PEGylated rHuPH20 caused a reduction in tumor growth, as evidenced by smaller tumor volumes at each post-treatment time-point, compared with the control group.

lated rHuPH20 removed all detectable hyaluronan in distal tumors in this human prostate cancer animal model.

B. Sustained, Systemic Exposure to PEGylated rHuPH20 Reduces Tumor Volume.

Ten PC-3 peritibial tumor-bearing mice were generated as described above, by peritibial implantation by inoculating athymic nude mice, intramuscularly (IM), with human PC3 prostate cancer cells (1×10⁶ cells per mouse, total volume of 0.05 mL) adjacent to the right tibial periosteum. PC-3 peritibial tumor bearing mice with approximately 300 mm³ tumor volumes were implanted sub-cutaneously (SC) with Alza pumps (Alzet® mini-osmotic pumps, Model No. 2002, Durect Corporation, Cupertino, Calif.), containing control buffer (API buffer) (5 animals—control group) or PEGylated rHuPH20 (5 animals), at approximately 20,000 enzymatic units (U) per 0.2 ml volume (0.7 mg/mouse (35 mg/Kg) administered to each mouse over 12 days). For each group, the pump delivered 0.5 microliters per hour, over 14 days, which, for the group treated with PEGylated rHuPH20 was equal to 50 U/per hour; 1,200 U/per day.

Tumor volume (mm³) was measured prior to treatment at day −1, and at termination of the study at day 12, by capturing images using the VisualSonic ultrasound system and using an ultrasound imaging software program. The results are set forth in Table 31, below. As noted in the Table, one mouse in the control group was found dead before the conclusion of the study.

TABLE 30

Repeated Systemic Administration of PEGylated rHuPH20 Reduces Tumor Growth in PC3 Tumor Model

| Amount PEGylated rHuPH20 per mouse (each treatment) | | Tumor volume (mm3) at various days compared to initiation of treatment | | | | | |
|---|---|---|---|---|---|---|---|
| | | −2 | 4 | 7 | 11 | 14 | 18 |
| 0 (control) | Average | 406.97 | 795.93 | 1017.15 | 1291.00 | 1733.69 | 1942.10 |
| | Standard Error | 15.86 | 52.61 | 70.82 | 75.72 | 88.88 | 181.76 |
| 1,000 U | Average | 418.48 | 456.01 | 586.78 | 929.09 | 1291.94 | 1465.20 |
| | Standard Error | 18.14 | 41.75 | 69.07 | 113.70 | 128.89 | 205.63 |
| 3,000 U | Average | 422.24 | 496.53 | 567.40 | 905.50 | 1281.85 | 1409.97 |
| | Standard Error | 17.13 | 27.68 | 32.58 | 53.39 | 132.05 | 192.96 |
| 10,000 U | Average | 423.19 | 429.38 | 607.00 | 865.88 | 1180.50 | 1405.52 |
| | Standard Error | 16.79 | 14.10 | 34.13 | 57.35 | 84.83 | 89.91 |
| 30,000 U | Average | 416.25 | 470.78 | 589.66 | 815.17 | 1039.30 | 1303.49 |
| | Standard Error | 13.42 | 27.90 | 39.04 | 73.87 | 119.10 | 127.75 |

To demonstrate removal of HA in the tumors of treated animals, tumors from animals in each group also were isolated, fixed and sectioned, as described in Example 8B.2, above. 5 μm sections were stained, as described in that Example. For immunohistochemistry, 5 μm tumor sections were stained using a biotin labeled hyaluronan binding protein (HABP-bio) (Seikagaku, Japan). After washing to remove the primary reagent, a FITC-labeled streptavidin (Vector Labs, Canada) was used as a secondary reagent. Nuclei were counter-stained using a DAPI (4′,6-diamidino-2-phenylindole) reagent. Micrographs were captured via a Nikon Eclipse TE2000U microscope coupled to a Insight FireWire digital camera (Diagnostic Instruments, Michigan). The results revealed no visible staining in tumors of each of the treated animals, demonstrating that systemic administration of 1,000, 3,000, 10,000 and 30,000 U PEGy-

TABLE 31

Continuous Administration of PEGylated rHuPH20 Reduces PC3 Tumor Volume

| Treatment Groups | | Tumor Volume (mm³) | |
|---|---|---|---|
| | | Day −1 | Day 12 |
| Control (API Buffer) | Mouse 1 | 160.82 | Found dead |
| | Mouse 2 | 245.18 | 777.22 |
| | Mouse 2 | 254.59 | 983.69 |
| | Mouse 4 | 355.1 | 743.72 |
| | Mouse 5 | 442.09 | 964.37 |
| | Average (±SE) | 291.56 ± 48.55 | 867.25 ± 62.15 |
| 20,000 U (total) per mouse PEGylated | Mouse 1 | 178.91 | 324.27 |
| | Mouse 2 | 212.19 | 439.67 |
| | Mouse 2 | 262.65 | 264 |
| | Mouse 4 | 286.13 | 426.5 |

TABLE 31-continued

Continuous Administration of PEGylated rHuPH20 Reduces PC3 Tumor Volume

| Treatment Groups | | Tumor Volume (mm³) | |
|---|---|---|---|
| | | Day −1 | Day 12 |
| rHuPH20 | Mouse 5 | 560.42 | 245.08 |
| | Average ±SE | 300.06 ± 67.62 | 339.904 ± 45.03 |

As set forth in Table 31, sustained intravenous exposure to PEGylated rHuPH20 (20,000 U total, over 12 days) reduced tumor growth, compared to the control animals. A significant difference ($p<0.0015$) was observed at day 12, between tumor volumes in the control group and the group treated with PEGylated rHuPH20. Thus, continuous administration of PEGylated rHuPH20 has antitumor effects in a human prostate tumor xenograft model.

Body weights of the mice also were measured on days −1, 0, 4, 6, 8 and day 11. These results are set forth in Table 32, below.

TABLE 32

Body Weights after Continuous Administration of Control Buffer or PEGylated rHuPH20

| Treatment Groups | | Day 0 | | Day 4 | | Day 6 | | Day 8 | | Day 11 | |
|---|---|---|---|---|---|---|---|---|---|---|---|
| | | BW (g) | % Ch | BW (g) | % Ch | BW (g) | % Ch | BW (g) | % Ch | BW (g) | % Ch |
| Control | Mouse 1 | 23.75 | 0.00 | 20.54 | −13.52 | 20.46 | −13.85 | 20.31 | −14.48 | fd | N/A |
| (API | Mouse 2 | 22.8 | 0.00 | 23.33 | 2.32 | 23.67 | 3.82 | 23.24 | 1.93 | 23.64 | 3.68 |
| Buffer) | Mouse 2 | 23.27 | 0.00 | 22.15 | −4.81 | 22.02 | −5.37 | 22.45 | −3.52 | 23 | −1.16 |
| | Mouse 4 | 21.82 | 0.00 | 21.82 | 0.00 | 21.57 | −1.15 | 21.96 | 0.64 | 22.41 | 2.70 |
| | Mouse 5 | 25.32 | 0.00 | 23.26 | −8.14 | 23.12 | −8.69 | 23.55 | −6.99 | 24.29 | −4.07 |
| | Avg | 23.39 | 0 | 22.22 | −4.83 | 22.17 | −5.05 | 22.30 | −4.49 | 23.33 | 0.29 |
| 20,000 U | Mouse 1 | 25.76 | 0.00 | 23.92 | −7.14 | 24.06 | −6.60 | 24.79 | −3.77 | 26.08 | 1.24 |
| (total) | Mouse 2 | 24.24 | 0.00 | 23.01 | −5.07 | 23.41 | −3.42 | 23.38 | −3.55 | 23.32 | −3.80 |
| per | Mouse 2 | 24.70 | 0.00 | 23.1 | −6.48 | 23.36 | −5.43 | 23.42 | −5.18 | 23.93 | −3.12 |
| mouse | Mouse 4 | 22.97 | 0.00 | 22.6 | −1.61 | 23.36 | 1.70 | 22.64 | −1.44 | 23.01 | 0.17 |
| PEGylated | Mouse 5 | 21.26 | 0.00 | 19.71 | −7.29 | 20.02 | −5.83 | 20.93 | −1.55 | 21.31 | 0.24 |
| rHuPH20 | Avg | 23.79 | 0.00 | 22.47 | −5.52 | 22.84 | −3.92 | 23.03 | −3.10 | 23.53 | −1.05 |

* Avg = average; BW (g) = body weight in grams; % Ch = percent change from day zero; fd = found dead.

Example 17

In Vivo HA Reducing Activity and Antitumor Activity of PEGylated rHuPH20 in Multiple HA-Expressing Tumors A. Systemic Administration of PEGylated rHuPH20 Removes HA in a Plurality of HA-Expressing Tumors Expression of hyaluronan (HA) was assessed, as described in Example 8B.2, above, in various tumors in animal models of tumors (listed in Table 33, below) two hours after intravenous administration of vehicle or PEGylated rHuPH20 (10,000 U/mouse=15 mg/Kg). The models were generated, as described below, from various cancerous cell lines.

(i) Cell Lines

The cancerous cell lines used to make the animal tumor models are listed in Table 33, below. Human hormone refractory prostate cancer cell lines (PC3, DU145); human pancreatic cancer cell lines (MIAPACA II, BXPC3); human breast cancer cell line (MDA MB 231); human colon cancer cell lines (HCT116, HT29) and human non small cell lung cancer cell line (NCI H460) were purchased from ATCC (Manassas, Va.). The Dunning rat prostate cancer cell line (Mat LyLu) was a kind gift from the Department of Medicine, Physiology and Oncology, McGill University Health Centre, Montreal, Quebec, H3A 1A 1 Canada. The mouse breast cell line (4T1-GFP) was a gift from Sidney Kimmel Cancer Center (SKCC, San Diego, Calif.). The human pancreatic cancer cell line, Capan-1 H2B, was a gift from Sidney Kimmel Cancer Center (SKCC, San Diego, Calif.).

The PC3 cells were maintained in Ham's F12K medium (Mediatech Inc.) with 2 mM L-glutamine, adjusted to contain 1.5 g/L sodium bicarbonate, with 10% Fetal Bovine Serum (FBS). MIA PACA II cells were maintained in Dulbecco's Modified Eagle's Medium with 10% FBS (Mediatech Inc.) Mat LyLu cells were maintained in RPMI 1640 with 10% FBS, 2 mM L-glutamine and 250 nM dexamethasone. Other cells were maintained in RPMI 1640 medium with 10% FBS. The PC3 human prostate cancer animal model was generated as described in Example 8, above. Animals were selected with tumor volumes that had reached approximately 400-800 m³, and then treated by intravenous injection of vehicle or PEGylated rHuPH20 (10,000 U/mouse=15 mg/Kg).

(ii) Animal Tumor Models

PC3 and Du145 Human Prostate Xenograft Models

The PC3 and Du145 xenograft tumor models were generated as follows, using PC3 and Du145 cells, respectively. Tumor cells at approximately 80% confluency were trypsinized, harvested, washed once in HBSS (Hank's balance salt solution, Mediatech Inc.), and re-suspended in 50% Matrigel® in HBSS at $2\times10^7$ cells/mL on ice before inoculation into animals. Athymic male nude mice were inoculated intramuscularly (IM) with 0.05 mL of this cell suspension, peritibially, in the left hind leg (adjacent to the tibia periosteum). When the volume of tumors in the animals appeared to reach 400 to 500 mm³, actual tumor volumes were determined using VisualSonics ultrasound, using two perpendicular axial dimensions.

Animals were randomly grouped into two groups of 3-4 animals each, and treated by intravenous injection of vehicle (API buffer) and PEGylated rHuPH20 (10,000 U/mouse=approximately 15 mg/Kg), respectively. Tumor tissues were harvested 2 hours after the treatment and fixed in 10% Neutral buffered Formalin solution (NBF) for further histological evaluation.

MIAPACA II, BXPC3 (Human Pancreatic Cancer Models), HCT116, HT29 (Human Colon Cancer Models) and NCI H460 (Human Non-Small Lung Cancer Model)

The MIAPACA II, BXPC3, HCT116, HT29 and NCI H460 xenograft tumor models were generated as follows, using the MIAPACA II, BXPC3, HCT116, HT29 and NCI H460 cells, respectively. Tumor cells at approximately 80% confluency were trypsinized, harvested, washed once in HBSS (Hank's balance salt solution, Mediatech Inc.), and re-suspended in HBSS at $2\times10^7$ cells/mL on ice before inoculation into animals. Athymic female nude mice were inoculated intramuscularly (IM) with 0.05 mL of cell suspension, peritibially, in the left hind leg (adjacent to the tibia periosteum). When the volume of tumors in the animals appeared to reach 400 to 500 mm$^3$, actual tumor volumes were determined using VisualSonics ultrasound. Animals were randomly grouped into two groups of 3-4 animals each, and treated by intravenous injection of vehicle (API buffer) and PEGylated rHuPH20 (10,000 U/mouse=approximately 15 mg/Kg), respectively. Tumor tissues were harvested 2 hours after the treatment and fixed in 10% Neutral buffered Formalin solution (NBF) for further histological evaluation.

MDA MB 231 Human Breast Cancer Xenograft Model

The MDA MB 231 human breast tumor xenograft model was generated as follows, using the MDA MB 231 cell line. Tumor cells at approximately 80% confluency were trypsinized, harvested, washed once in HBSS (Hank's balance salt solution, Mediatech Inc.), and resuspended in 50% Matrigel® in HBSS solution at $4\times10^7$ cells/mL, on ice, prior to inoculation. Athymic female nude mice were inoculated orthotopically in the mammary fat pad with 0.05 mL of the cell-Matrigel® suspension. Due to poor tumor take, tumor tissue transplantation was performed to generate more tumor bearing animals for the study. Animals having tumor volumes of more than 500 mm$^3$ were selected and tumors excised from these animals, rinsed in sterile medium and minced with a blade into 1 mm cubes. These tumor tissues then were implanted into the mammary fat pads of female nude mice using a Trocar.

The length (L) and width (W) of the solid tumor mass were measured with a caliper twice weekly and the tumor volume (TV) was calculated as: $(L\times W^2)/2$. When the volume of their tumors reached about 1000 mm$^3$, animals were divided randomly into two groups of 5 mice each, and animals in the two groups treated by intravenous injection of vehicle or PEGylated rHuPH20 (3000 U/mouse=approximately 4.5 mg/Kg), respectively. Tumor tissue was harvested 3 days after the treatment and fixed in 10% Neutral buffered Formalin solution (NBF) for further histological evaluation.

Capan-1 Human Pancreatic Tumor Xenograft Model

The Capan-1 human pancreatic xenograft tumor model was generated, as follows, using the Capan-1 HB2 cell line. Tumor cells at approximately 80% confluency were trypsinized, harvested, washed once in HBSS (Hank's balance salt solution, Mediatech Inc.), and resuspended in HBSS solution at $5\times10^7$ cells/mL, on ice, prior to inoculation. Athymic female nude mice were inoculated subcutaneously with 0.1 mL of the cell suspension. The length (L) and width (W) of the solid tumor mass were measured by caliper twice weekly and the tumor volume (TV) was calculated as: $(L\times W^2)/2$. When the volume of their tumors reached approximately about 500-700 mm$^3$, animals were divided randomly into two groups of 3-4 mice each. Animals in these groups were treated by intravenous injection of vehicle (API buffer) and PEGylated rHuPH20 (5000 U/mouse=approximately 7.5 mg/Kg), respectively. Tumor tissues were harvested 3 days after the treatment and fixed in 10% Neutral buffered Formalin solution (NBF) for further histological evaluation.

4T1-GFP Breast Cancer Tumor Model

The 4T1-GFP breast cancer model was generated as follows, using the 4T1-GFP cell line. 4T1-GFP tumor cells at ~80% confluency were trypsinized, harvested, washed once in HBSS (Hank's balance salt solution, Mediatech Inc.), and resuspended in HBSS at $2\times10^6$ cells/mL on ice, prior to inoculation. Female Balb/c mice were inoculated orthotopically in the mammary fat pad with 0.05 mL of the cell suspension. The length (L) and width (W) of the solid tumor masses were measured by caliper twice weekly and the tumor volume (TV) was calculated as: $(L\times W^2)/2$. When the tumor volume reached approximately 500-700 mm$^3$, animals were divided randomly into two groups of 3-4 mice each, and the groups treated by intravenous injection of vehicle and PEGylated rHuPH20 (10,000 U/mouse=approximately 15 mg/Kg), respectively. Tumor tissue was harvested 2 hours after the treatment and fixed in 10% Neutral buffered Formalin solution (NBF) for further histological evaluation.

Mat LyLu Rat Prostate Tumor Model

The Mat LyLu tumor model was generated using the Mat LyLu cell line, as follows. Tumor cells at approximately 80% confluency were trypsinized, harvested, washed once in HBSS (Hank's balance salt solution, Mediatech Inc.), and resuspended in HBSS at $1\times10^6$ cells/mL on ice, prior to inoculation. Athymic male nude mice were inoculated intramuscularly with rat Mat LyLu prostate cancer cells ($2\times10^5$ cells per mouse in a total volume of 0.04 mL) adjacent to the right tibial periosteum. When tumor volume appeared to reach 400 to 500 mm$^3$, actual volumes were determined using VisualSonics ultrasound. Animals were randomly put into two groups of 3-4 each, which were treated by intravenous injection of vehicle and PEGylated rHuPH20, respectively. Tumor tissues were harvested 2 hours after the treatment and fixed in 10% Neutral buffered Formalin solution (NBF) for further histological evaluation.

(iii) Immunohistochemistry

The fixed tumors from each animal model (Example 17A(ii), above) were cut into 5 μm sections. To assess amount of hyaluronan (HA) in the harvested tumor, the sections were stained using a biotin labeled hyaluronan binding protein (HABP-bio) (Seikagaku, Japan). After washing to remove the primary reagent, a FITC-labeled streptavidin (Vector Labs, Canada), or a Texas Red-labeled streptavidin (for the 4T1-GFP tumor sections; Vector Labs, Canada) was used as a secondary reagent. Nuclei were counter-stained using a DAPI (4',6-diamidino-2-phenylindole) reagent. Micrographs were captured via a Nikon Eclipse TE2000U microscope coupled to a Insight FireWire digital camera (Diagnostic Instruments, Michigan).

HA expression in the sections was graded by the level of fluorescent intensity in the sections (in the tumor area and the associated stromal area), using a scoring system ranging from +++ (intense staining in greater than 80% of the visual field), to +/− (sparse staining), to − (no visible staining). The results are presented in Table 33, below. The table indicates the name of each cell line used to generate the mouse xenograft models, the type of tumor and species the cell line was isolated from. Degree of HA expression is indicated for each tumor type model, after treatment with vehicle and PEGylated rHuPH20. The results indicate that HA expression was reduced by treatment with PEGylated rHuPH20 in all HA-expressing tumors. As noted in the Table, the HT29 tumor sections and the Capan-1 tumor sections (from animals injected with vehicle) exhibited negative staining in pericellular areas and positive staining in stroma, prior to PEGylated.

TABLE 33

Hyaluronan (HA) Expression Reduction in HA-Expressing Tumors Following Systemic Administration with PEGylated rHuPH20

| Tumor cell line name | Tumor Type | Tumor Source Species | HA expression in Tumor tissue | |
|---|---|---|---|---|
| | | | Vehicle | PEGylated rHuPH20 |
| PC-3 | Prostate | Human | +++ | – |
| 4T1 | Breast | Mouse | ++ | – |
| MIA PACA II | Pancreas | Human | ++ | – |
| BxPC3 | Pancreas | Human | +/++ | – |
| MatLyLu | Prostate | Rat | + | – |
| MDA MB 231 | Breast | Human | + | – |
| HCT 116 | Colon | Human | +/– | – |
| HT29* | Colon | Human | +/– | – |
| NCI H460 | NSCLC | Human | +/– | – |
| Du145 | Prostate | Human | +/– | – |
| Capan-1* | Pancreas | Human | – | – |

*Negative staining in pericellular areas; positive staining in stroma

B. Dose-Dependent Removal of Tumor HA by PEGylated rHuPH20 in Exemplary HA-Rich Tumors Animals in one exemplary HA-rich (++) tumor model, 4T1-GFP, generated as described above, were treated with vehicle and various amounts (10, 100, 1,000, 3,000 and 10,000 enzymatic units (U) per mouse) of PEGylated rHuPH20. Three days (72 hours) after administration of this treatment, peritibial tumors from the mice were harvested and fixed in normal buffered formalin. Levels of hyaluronan (HA) in the tumors were assessed by immunohistochemistry (IHC), as described in Example 17A, above, using avidin-Texas Red as a secondary. Hematoxylin/Eosin (H&E) staining also was done on the tumor sections. The results revealed a dose-dependent reduction in HA staining in the tumor sections from animals treated with 100, 1,000, 3,000 and 10,000 U PEGylated rHuPH20. In the sections from animals receiving 1,000, 3,000 and 10,000 U PEGylated rHuPH20, no visible staining was observed. These results indicated that a single systemic, administration of PEGylated rHuPH20 can reduce hyaluronan in a breast distal tumor model for at least three days.

C. PEGylated rHuPH20 Administration Inhibits Tumor Growth and Increases Survival in HA-Rich Tumor Models To demonstrate that repeated administration of PEGylated rHuPH20 alone produces anti-tumor effects in a plurality of tumor model systems, tumor growth and survival was assessed in three different mouse tumor models generated using cell lines listed in the previous example. In these studies, two different prostate cancer models (PC3 (HA +++, as determined in Example 17A, above) and Mat LyLu (HA+, as determined in Example 17A, above)) and one breast cancer model (4T1-GFP (HA++, as determined in Example 17A, above) were treated with PEGylated rHuPH20.

For these studies, a total of six groups of mice (one control and experimental group for each tumor model, respectively (n=6-8 animals per group) were dosed as described below with PEGylated rHuPH20 and assessed for tumor volume and survival. For each group, tumor growth was measured before treatment and then monitored over the course of treatment using the VisualSonics Imaging Micro-ultrasound system. The effect of PEGylated rHuPH20 treatment on animal survival was assessed by equating a 1500 mm$^3$ endpoint tumor volume to a moribund state, as described below.

The PC3 human prostate cancer model was generated as described above. Athymic male nude mice were inoculated intramuscularly with human PC3 prostate cancer cells ($1 \times 10^6$ cells per mouse in a total volume of 0.05 mL) adjacent to the right tibial periosteum to generate tumors with high interstitial fluid pressure. Tumors were allowed to grow to a mean tumor volume of 400-500 mm$^3$ before initiation of intravenous treatment with 3,000 enzymatic units (U) per mouse of PEGylated rHuPH20, or with control vehicle (API-buffer). n=7 mice per group. The animals were treated every third day on a Q3dx9 schedule (once every three days, total of nine doses), on days 0, 3, 6, 9, 12, 15, 18, 21 and 24.

As described above, the 4T1-GFP breast tumor model was generated by inoculating BALB/c female mice orthotopically in the mammary fat pad with 4T1-GFP breast cancer cells ($5 \times 10^5$ cells per mouse in a total volume of 0.05 mL). Tumors were allowed to grow to a mean tumor volume of 100 mm$^3$ before initiation of intravenous treatment. For treatment, mice were injected, every other day (EOD) for a total of six doses (Q2dx6 regimen), on days 0, 2, 4, 7, 9 and 11, with API-buffer (Control group) or with 3,000 enzymatic units (U) per mouse, PEGylated rHuPH20. n=6-8 mice per group.

For the Mat LyLu prostate tumor model, athymic male nude mice were inoculated intramuscularly with rat Mat LyLu prostate cancer cells ($2 \times 10^5$ cells per mouse in a total volume of 0.04 mL) adjacent to the right tibial periosteum to generate tumors with high interstitial fluid pressure. Tumors were allowed to grow to a mean tumor volume of 100 mm$^3$ before initiation of treatment. For treatment, animals were dosed intravenously with API-buffer (Control group) or with 3000 U PEGylated rHuPH20. n=6-8 animals per group. Dosing was administered every other day, three times weekly, on Monday, Wednesday and Friday (Q2dx6), on days 0, 2, 4, 7, 9 and 11. Mat LyLu tumors in the control group, however, had reached critical volume or greater than 2,000 mm$^3$ by day 11, and thus were sacrificed for humane reasons.

For each group of PC3-tumor bearing animals, tumor growth was monitored using the VisualSonics (VS) Imaging Micro-ultrasound system. Tumor growth in the 4T-1 and Mat LyLu-tumor bearing animals was measured with calipers. Serial tumor volumes were obtained by bi-dimensional diameter measurements with calipers, using the formula 0.4 (a×b$^2$) where "a" is the major tumor diameter and "b" the minor perpendicular diameter.

The results of this study, which assessed tumor volume and survival over time, are discussed in the following sections. The tumor volume data are described in section (i), below, and are presented in Tables 33-36, and in the top panel of FIG. 9. The survival data are described in section (ii), below, and are presented in Table 38 and in the bottom panel of FIG. 9.

(i) Tumor Volume Effects

The VS-ultrasound and caliper tumor volumes were expressed in mm$^3$. For the two groups (control and 3000 U PEG-rHuPH20) of PC3 tumor-bearing animals, measurements were taken on days –1, 3, 6, 10, 13, 17, 20, 24, 27, 31, 34, 38, 41 and 45. The results are set forth in Table 34. Animals with tumors reaching over 1500 mm$^3$ were sacrificed for humane reasons as described below. Thus, for the PC3 model, no measurements were made after day 27, as 100% of the animals had reached this tumor weight. For the two groups of 4T1-GFP-bearing tumors, the caliper measurements were taken on days 0, 2, 4, 7, 9, 11, 14, 16, 18, and 21. The results are set forth in Table 35. For the two groups of Mat Ly Lu-bearing tumors, the caliper measurements were taken on days 0, 2, 4, 7 and 9. The results are set forth in Table 36.

TABLE 34

Repeated Systemic PEGylated rHuPH20 Administration Effects Tumor Volume over Time in PC3 Prostate Tumor Model

| TUMOR VOLUME ($mm^3$) at day compared to initiation of treatment | TREATMENT (U/mouse rHuPH20) | | | |
|---|---|---|---|---|
| | 0 (API Buffer) | | 3000 | |
| | Average | SEM | Average | SEM |
| Day −1 | 440.31 | 27.05 | 439.00 | 28.01 |
| Day 3 | 494.05 | 15.99 | 298.65 | 29.98 |
| Day 6 | 774.09 | 40.86 | 486.72 | 30.37 |
| Day 10 | 1043.11 | 98.11 | 575.10 | 50.58 |
| Day 17 | 1606.10 | 168.80 | 783.10 | 86.90 |
| Day 20 | 1930.10 | 242.00 | 1009.30 | 134.10 |
| Day 24 | 2450.20 | 239.20 | 1065.50 | 153.80 |
| Day 27 | 2926.20 | 281.70 | 1205.50 | 193.10 |
| Day 31 | N/A | N/A | 1364.90 | 231.80 |
| Day 34 | N/A | N/A | 1520.80 | 268.10 |
| Day 38 | N/A | N/A | 1714.40 | 321.90 |
| Day 41 | N/A | N/A | 1963.80 | 379.90 |

*NA = not applicable - all animals sacrificed due to tumor volumes over 1500 $mm^3$.

TABLE 35

Repeated Systemic PEGylated rHuPH20 Administration Effects Tumor Volume over Time in 4T1 Breast Tumor Model

| TUMOR VOLUME ($mm^3$) at day compared to initiation of treatment | TREATMENT (U/mouse rHuPH20) | | | |
|---|---|---|---|---|
| | 0 (API Buffer) | | 3000 | |
| | Average | SEM | Average | SEM |
| Day 0 | 63.27 | 11.13 | 67.36 | 10.75 |
| Day 2 | 159.02 | 14.45 | 147.41 | 10.40 |
| Day 4 | 226.97 | 22.63 | 158.66 | 22.71 |
| Day 7 | 271.64 | 28.77 | 184.21 | 17.47 |
| Day 9 | 438.28 | 62.57 | 251.37 | 28.77 |
| Day 11 | 638.49 | 113.56 | 336.46 | 39.99 |
| Day 14 | 1099.31 | 254.54 | 483.68 | 93.73 |
| Day 16 | 1468.76 | 260.78 | 650.66 | 115.87 |
| Day 18 | 1707.37 | 225.72 | 861.36 | 171.18 |
| Day 21 | 2254.99 | 375.00 | 1227.40 | 352.71 |
| Day 25 | 2693.19 | 279.51 | 1536.89 | 398.65 |

TABLE 36

Repeated Systemic PEGylated rHuPH20 Administration Effects Tumor Volume over Time in Mat LyLu Prostate Tumor Model

| TUMOR VOLUME ($mm^3$) at day compared to initiation of treatment | TREATMENT (U/mouse rHuPH20) | | | |
|---|---|---|---|---|
| | 0 (API Buffer) | | 3000 | |
| | Average | SEM | Average | SEM |
| Day 0 | 76.10 | 10.80 | 75.70 | 17.80 |
| Day 2 | 355.70 | 35.20 | 208.00 | 56.90 |
| Day 4 | 853.00 | 29.80 | 470.90 | 61.20 |
| Day 7 | 2248.80 | 96.50 | 1518.90 | 158.10 |
| Day 9 | 3571.00 | 305.40 | 2384.40 | 382.10 |

As indicated by the tumor volume measurements, repeated intravenous administration of PEGylated rHuPH20 reduced tumor growth in each of the models, with a correlation to the amount of HA in the tumors, as determined in Example 17A, above. For example, a significant difference in tumor volume between the PEGylated rHuPH20 treated and control groups in each tumor model (p=0.001 at day 27 in the PC3 prostate cancer model; p=0.04 at day 14 in the 4T1 breast cancer model; and p=0.02 at day 9 in the Mat LyLu prostate cancer model).

Percent Tumor Growth Inhibition (TGI) for each respective tumor model was calculated using the following equation:

$$\% \text{ TGI} = [1-(T_n-T_0) \div (C_n-C_0)] \times 100\%$$

where "$T_n$" is the average tumor volume for the treatment group (animals receiving PEGylated rHuPH20) at day "n" (here, day 27, day 14 and day 9 for PC3, 4T1 and Mat LyLu models, respectively) after the final dose of PEGylated rHuPH20; "$T_0$" is the average tumor volume in that treatment group at day 0, before treatment; "$C_n$" is the average tumor volume for the corresponding control group at day "n" (here, day 27, day 14 and day 9 for PC3, 4T1 and Mat LyLu models, respectively; some time after the final dose of vehicle); and "$C_0$" is the average tumor volume in the control group at day 0, before treatment. Time to Tumor Volume (TTV) for the respective tumor model was calculated as the average time to reach tumor volume of 1,500 $mm^3$.

TABLE 37

Tumor Growth Inhibition

| | TUMOR MODEL | | |
|---|---|---|---|
| | PC3 (n = day 27) | 4T1 (n = day 14) | Mat LyLu (n = day 9) |
| $C_n-C_0$ | 2485.89 ± 270.94 | 1049.74 ± 262.07 | 3494.96 ± 304.94 |
| $T_n-T_0$ | 766.26 ± 217.15 | 412.36 ± 81.90 | 2308.63 ± 397.76 |
| TGI | 70% | 60% | 34% |

As demonstrated in Table 37, the results of this study revealed a 70%, 60% and 34% Tumor Growth Inhibition (TGI) by systemic PEGylated rHuPH20 administration, in the PC3 prostate, 4T1 breast and Mat LyLu prostate tumor models, respectively (at day 27, day 14 and day 9 post administration, respectively).

As demonstrated in FIG. 9 and in Tables 34-37, the effect on tumor volume correlated with the level of tumor HA expression, as determined in Example 17A, above. For example, the tumor volume was most reduced (TGI=70%) by PEGylated rHuPH20 in the model with the highest relative HA expression in tumors (PC3 (HA+++), and least (TGI=34%) in the model with the lowest relative HA expression in the tumors (Mat LyLu (HA+). The reduction in tumor volume was intermediate (TGI=60%) in the 4T1-GFP model, which displayed a relative HA level of ++ in Example 17A, above.

(ii) Survival Effects

Effect of systemic, repeated, PEGylated rHuPH20 administration on survival was assessed in each model by determining the percentage of "surviving" animals at each timepoint in each group. For this study, a tumor volume of greater than or equal to 1500 $mm^3$ was selected as an endpoint, which was considered analogous to a moribund (non-surviving) state. Thus, animals with tumor volumes below 1500 $mm^3$ were considered surviving, while animals with tumor weights 1500 $mm^3$ or greater were considered morbid.

The effects of survival by repeated administration of PEGylated rHuPH20 on the various models are set forth in FIG. 9 (bottom panel). As demonstrated in FIG. 9 (bottom panel), treatment with PEGylated rHuPH20 resulted in a 2-fold, 1.7-fold and 1.5-fold delay in reaching the designated moribund state, in the PC3, 4T1-GFP and Mat LyLu tumor models, respectively, compared to control treatment. Thus, the effect on survival also correlated with the relative expression of HA in the tumors, as measured in Example 17A, above.

The Median Survival Time (MST), in days, was determined for each animal group, as the median time before mice in each group reached the designated 1500 mm$^3$ tumor volume endpoint. Percent ILS (Increase in Life Span), a measure of anti-tumor activity by the PEGylated rHuPH20 compared to control, was calculated for each model, using the following equation:

% ILS=[(T−C)/C]×100 where "T" is the MST of the group treated with PEGylated rHuPH20 and "C" is the MST for the control group. By National Cancer Institute (NCI) criteria, a treatment with a % ILS greater than 25% is considered effective. The results are summarized in Table 38, below.

TABLE 38

Median Survival Time and Increase in Life Span

| | MODEL | | | | | |
|---|---|---|---|---|---|---|
| | PC3 | | 4T1 | | Mat LyLu | |
| TREATMENT | MST | ILS | MST | ILS | MST | ILS |
| Control | 16.13 | N/A | 16.57 | N/A | 5.67 | N/A |
| 3000 U PEG-PH20 | 31.83 | 97% | 28.66 | 73% | 8.83 | 56% |

N/A = not applicable

As set forth in Table 38, above, the systemic treatment with PEGylated rHuPH20 caused an increase in life span (ILS) of 97%, 73% and 56%, in the PC3 prostate, 4T1 breast and Mat LyLu prostate tumor models, respectively, again correlating with the measured relative HA levels in the tumors as described in Example 17A, above (+++, ++ and + respectively).

These results demonstrate that repeated, systemic administration of PEGylated soluble hyaluronidase, alone, is effective as an anti-cancer treatment in a number of HA-rich tumor models, and that the degree of anti-tumor effects are correlated with the expression of HA in the tumors.

(iii) Reduction of HA in Tumors

Further, tumors were harvested after the final PEGylated rHuPH20 or control treatment, for immunohistochemical detection of tumor tissue hyaluronan. For this study, PC-3 tumors were harvested 72 hours following the final treatment (day 20), 4T1-GFP tumors were harvested 72 hours following the final treatment (day 14) and the Mat LyLu tumors were harvested 24 hours following the final treatment (day 12). The harvested tumors were fixed in normal buffered formalin (NBF) and 5 μm sections cut and stained using a biotin labeled hyaluronan binding protein (HABP-bio) (Seikagaku, Japan). After washing to remove the primary reagent, a FITC-labeled streptavidin (Vector Labs, Canada), for the PC-3 and Mat LyLu tumors, or a Texas Red-labeled streptavidin was used as a secondary reagent. Nuclei were counter-stained using a DAPI (4',6-diamidino-2-phenylindole) reagent. Micrographs were captured via a Nikon Eclipse TE2000U inverted fluorescent microscope coupled to a Insight FireWire digital camera (Diagnostic Instruments, Michigan) or ZEISS overhead scope (Carl Zeiss, Inc.) that has the same imaging system. The results revealed strong HA staining in the control tumors, but no detectable hyaluronan staining in the tumors from the animals that had been treated with PEGylated rHuPH20, demonstrating the sustained reduction in tumor hyaluronan caused by the treatment.

Example 18

Blood Brain Barrier Permeability of PEGylated rHuPH20 and Treatment of Brain Tumor Model The study was carried out to demonstrate that PEGylated rHuPH20 could reduce hyaluronic acid (HA) in brain tumors in an animal model and could increase survival in combination with radiotherapy.

A. Brain Tumor Model

To generate the brain tumor model, 4×10$^4$ PC3 cells in 2 μl of Hanks medium were injected into the right cerebral hemisphere with a stereotaxic frame of each mouse in various groups, as follows.

B. Blood Brain Barrier Permeability and Degradation of Brain HA by Intravenously Administered PEGylated rHuPH20

This study was carried out to demonstrate that intravenously administered PEGylated rHuPH20 can degrade HA in brain tumors. 3,000 enzymatic units (U) PEGylated rHuPH20, and control buffer (API) were administered intravenously to different groups of brain tumor model animals described in Example 18A, above. The animals were sacrificed four hours later. Brains were subsequently collected and sectioned for analysis.

For assessment of compromised Blood Brain Barrier (BBB) in the tumor model animals, a BBB permeability assay was performed on a subset of the animals. For this assay, 0.1 mL of 2% Evan's Blue Dye was injected intravenously into the tail vein of these mice, one hour prior to sacrifice. Cerebral sections were made and visualized as described below. Blue dye in cerebral sections indicated the presence of Albumin, a large serum protein (67 kDa) that had complexed with Evans Blue, indicating increased BBB permeability (the BBB's relative "leakiness").

For assessment of the amount of HA in the brain tumors following treatment, brain sections were incubated a biotin labeled hyaluronan binding protein (HABP-bio) (Seikagaku, Japan). After washing to remove the primary reagent, a FITC-labeled streptavidin (Vector Labs, Canada) was used as a secondary reagent. Nuclei were counter-stained using a DAPI (4',6-diamidino-2-phenylindole) reagent. Hematoxylin/Eosin staining also was done to identify the tumor in the brain. Micrographs were captured via a Nikon Eclipse TE2000U microscope coupled to a Insight FireWire digital camera (Diagnostic Instruments, Michigan) or a Leitz overhead scope that has the same image capturing system.

The results revealed a strong HA staining in control animals (API buffer), but no detectable HA staining in the animals that had been injected with PEGylated rHuPH20, demonstrating that this enzyme can be used to reduce HA in brain tumors when administered intravenously.

C. Survival of Animals after PEGylated rHuPH20 Treatment

To assess survival of brain tumor model animals after treatment with PEGylated rHuPH20 alone, twenty of the PC3 brain tumor model mice (described in Example 18A, above) were stayed on Day 12 post injection. The mice were injected in the tail vein, twice a week for four weeks, either with 5000 enzymatic units (U) of PEGylated rHuPH20 (ten mice), or API buffer (ten control mice).

Figure 10:
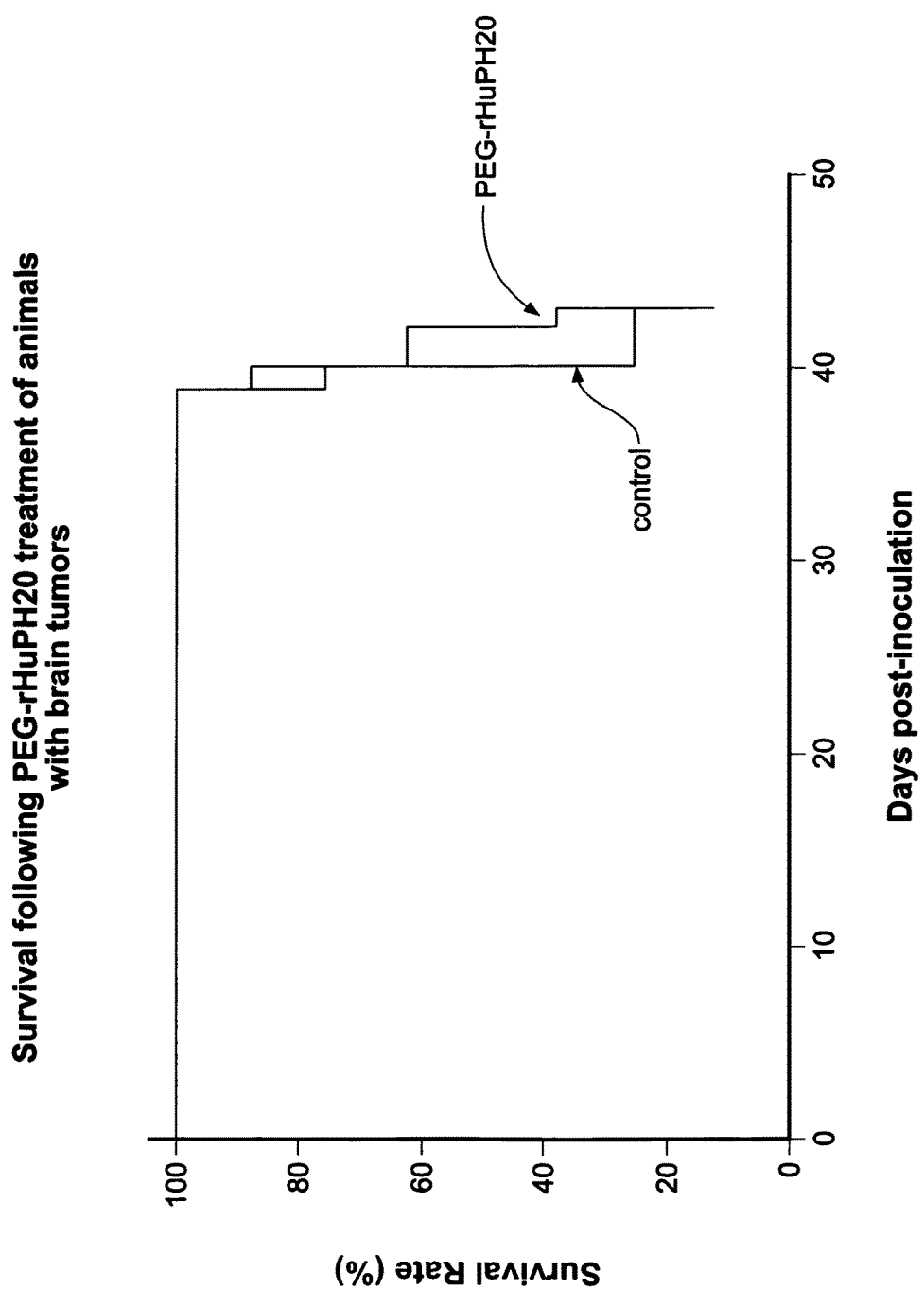
FIG. 10 depicts the percentage of mice surviving at various points following treatment with PEGylated rHuPH20 or control buffer in a PC3 brain tumor model, as described in Example 18. Survival was determined by assessing the number of mice that were alive at the indicated time.

Survival rate of the animals was monitored over time by monitoring death of the animals. The results, set forth in FIG. 10, indicated no significant change in survival between the PEGylated rHuPH20 treated and control animals.

D. Effects on Survival of PEGylated rHuPH20 in Combination with Radiotherapy

To assess survival of brain tumor model animals after treatment with PEGylated rHuPH20 in combination with radiation, three groups of the PC3 brain tumor model mice (described in Example 18A, above) were used.

For this study, twenty-seven tumor-bearing mice were staged into three groups (A, B and C) based on body weights at day 13, post-inoculation. For each group, dosing was initiated on Day 13 post inoculation of the PC3 cells. Each treatment/control was administered using a q3d×4 regime (every third day, total of four times). At each administration, Group A, the control group, was given intravenous injection of 100 μL API buffer alone. Group B was treated with whole-brain radiation (5 Gy). Group C, the combination therapy group, was treated with 5000 enzymatic units of PEGylated rHuPH20 (in 100 μL API buffer), followed four hours later by whole-brain radiation (3 Gy). This dosing regime is set forth in Table 39, below.

TABLE 39

Dosing Regime

| Group | Treatment | Dosage | Route | Regimen | Number of animals |
|---|---|---|---|---|---|
| A | API buffer | 100 μl | iv | q3d × 4 | 9 |
| B | Radiation | 3 Gy | WBR** | q3d × 4 | 9 |
| C | Radiation PEGPH20* | 3 Gy 5000 U | WBR iv | q3d × 4 | 9 |

*PEGPH20 administered 4 hours prior to radiation.
**WBR, Whole Brain Radiation

Figure 11:
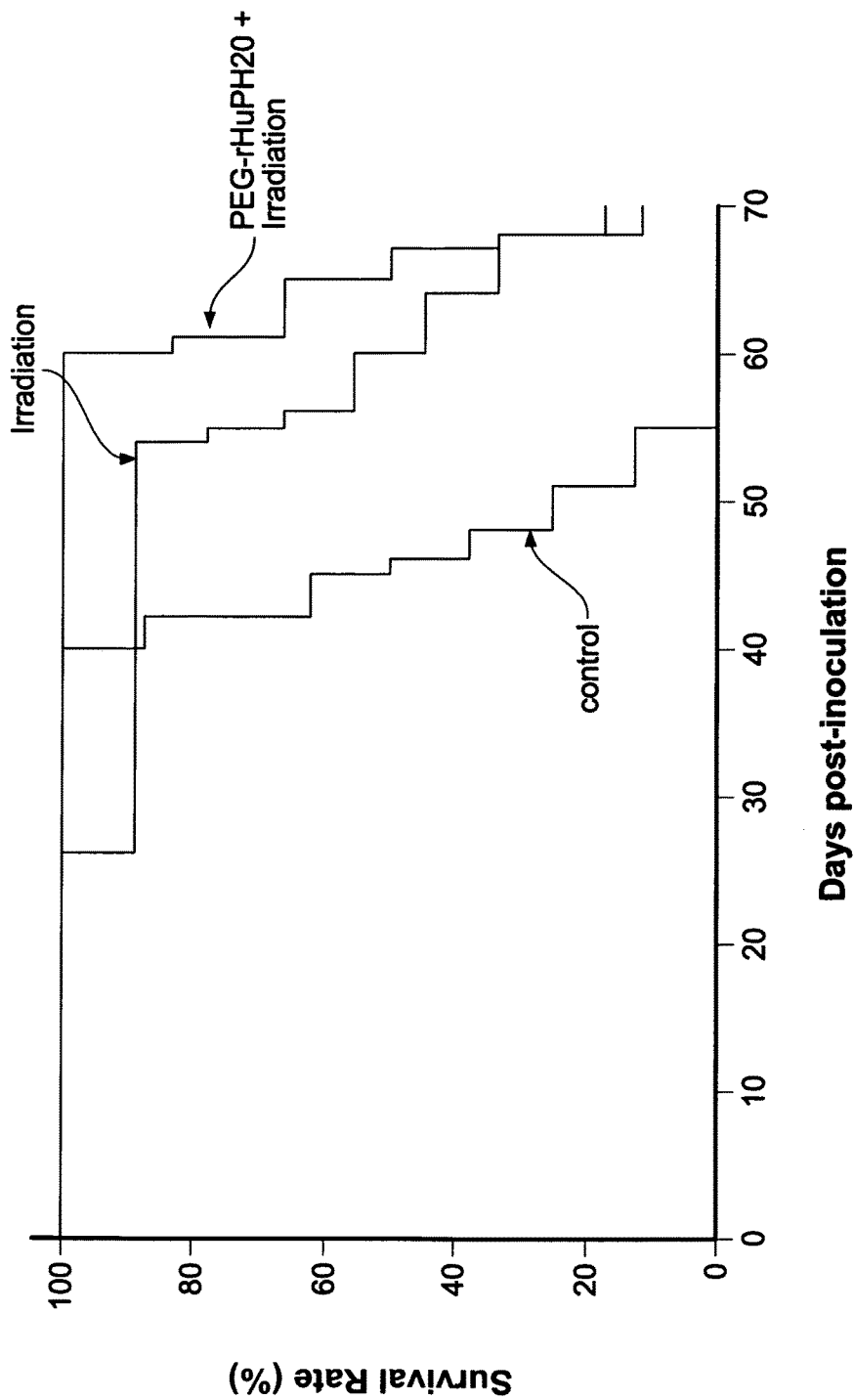
FIG. 11 depicts the percentage of mice surviving at various points following treatment with control buffer, irradiation, or combination therapy of irradiation and PEGylated rHuPH20 in a PC3 brain tumor model, as described in Example 18. Survival was determined by assessing the number of mice that were alive at the indicated time.

Survival of animals in each group was monitored over time by monitoring death of the animals. The results, which are set forth in FIG. 11 and in Table 40, indicated improved survival with combination treatment (radiation and PEGylated rHuPH20; Group C) over control (no treatment) (up to 45% longer survival), and an improvement in survival with combination treatment (radiation and PEGylated rHuPH20; Group C) over radiation alone (Group B) (up to 10% longer survival).

TABLE 40

| Group | Treatment | Median Survival Day | % longer survival compared to no treatment (negative control) | % longer survival compared to single radiation treatment (positive control) |
|---|---|---|---|---|
| A | API | 45.5 | N/A | N/A |
| B | Radiation | 60 | 31 | N/A |
| C | Radiation + PEGPH20 | 66 | 45 | 10 |

Example 19

Pharmacokinetic Properties of PEGylated rHuPH20 in Animals

The pharmacokinetic properties of pegylated rHuPH20 (made with mPEG-SBA-30K as described in Example 7, above) were evaluated in ICR mice from Harlan (Indianapolis, Ind.), rats, and Cynomolgus monkeys by measuring plasma hyaluronidase in blood samples, at a number of time-points following intravenous administration of the agent.

In mice, the study was carried out over a period of seventy hours. At "time zero" of this study, female ICR mice from Harlan, weighing 19-25 grams each, were injected, via the lateral tail vein, with approximately 3000 U purified, pegylated rHuPH20, which had been diluted to 0.5 mg/ml. In most cases, blood from the retro-orbital plexus by glass capillary was taken five minutes post-treatment, for later evaluation. Animals then were returned to their cages. At various time-points following administration of PEGylated rHuPH20, blood samples were taken from the retro-orbital plexus by glass capillary from animals that had been briefly anesthetized with 5% isoflurane. The blood from each sample was mixed with EDTA in a purple-top Microtainer blood collection tube to prevent coagulation. The tubes were centrifuged at 5000 rpm on a table-top centrifuge for 15 minutes, and the plasma transferred to a new Eppendorf tube. Plasma was frozen at −20° C., before being assayed to determine hyaluronidase activity.

For determination of plasma hyaluronidase activity at the various time-points, a standard micro turbidity plate assay, as described in Example 2, above, was performed on the plasma to measure the amount of hyaluronidase activity in the plasma. Because of the low total blood volumes in mice, only two or three blood draws were carried out per animal, over the course of the study. Accordingly, pharmacokinetic curves were fitted to multiple animals across the entire time course. PK curve fitting was done using either GraphPad Prism® (GraphPad Software, Inc., La Jolla, Calif.) software or WinNonLin software (Pharsight® Corporation, Mountain View, Calif.).

Similar studies were performed in rats and Cynomolgus monkeys. In rats, the study was carried out over a period of 96 hours. In a study similar to that described above for mice, rats were administered 125,000 U/kg (approximately 4 mg/kg) pegylated rHuPH20. Plasma hyaluronidase activity was monitored at various time-points using a standard micro turbidity plate assay, as described in Example 2, above. Three rats were evaluated per time point. In Cynomolgus monkeys, a MPI 28 day intravenous dose study was performed wherein pegylated rHuPH20 was administered to two female monkeys in escalating doses of 0.5, 2.0 and 6.0 mg/kg. The monkeys were allowed to clear all pegylated rHuPH20 prior to subsequent dosing. Plasma hyaluronidase activity was monitored at various time-points over 96 hours using a standard micro turbidity plate assay, as described in Example 2, above. Intravenous dose comparisons of pegylated rHuPH20 for mice, rats and Cynomolgus monkeys are set forth in Table 41.

TABLE 41

| Species | Route | Dose |
|---|---|---|
| mouse | IV | 100000 U/mouse |
| Rat | IV | 125000 U/kg |
|  |  | 85000 U/kg |
|  |  | 56077 U/kg |
| Cyno Mk | IV | 15000 U/kg (0.5 mg/kg) |
|  |  | 60000 U/kg (2.0 mg/kg) |
|  |  | 180000 U/kg (6.0 mg/kg) |

Pharmacokinetic regression curves were fitted to the derived data, and plasma half-life ($T_{1/2}$) was determined using the following equations in GraphPad Prism® (GraphPad Software, Inc., La Jolla, Calif.).

Plasma half life was determined using Prism software for non-linear regression. The standardized formula for half life curve fitting after intravenous injection is:

$$C_p = C_0 \exp(-k_{el})t$$

where $k_{el} = 0.693/T_{1/2}$
t=time after test article administration
$C_0$ is theoretical starting value
$C_p$ is the measured value at time t
The following equations were used:
One component exponential decay:

$$Y = \text{span1} * \exp(-k_{el}X) + \text{plateau};$$

where $k_{el}$ is the decay rate constant equal to $0.693/T_{1/2}$ and plateau is the asymptotic value as decay approaches infinity. Two-component exponential decay:

$$Y = \text{span1}*\exp(-k1_{el}X) + \text{span2}*\exp(-k2_{el}X) + \text{plateau};$$

where $k1_{el}$ and $k2_{el}$ are decay rate constants for span 1 and span 2, respectively, and plateau is the asymptotic value as decay approaches infinity.

Figure 12:
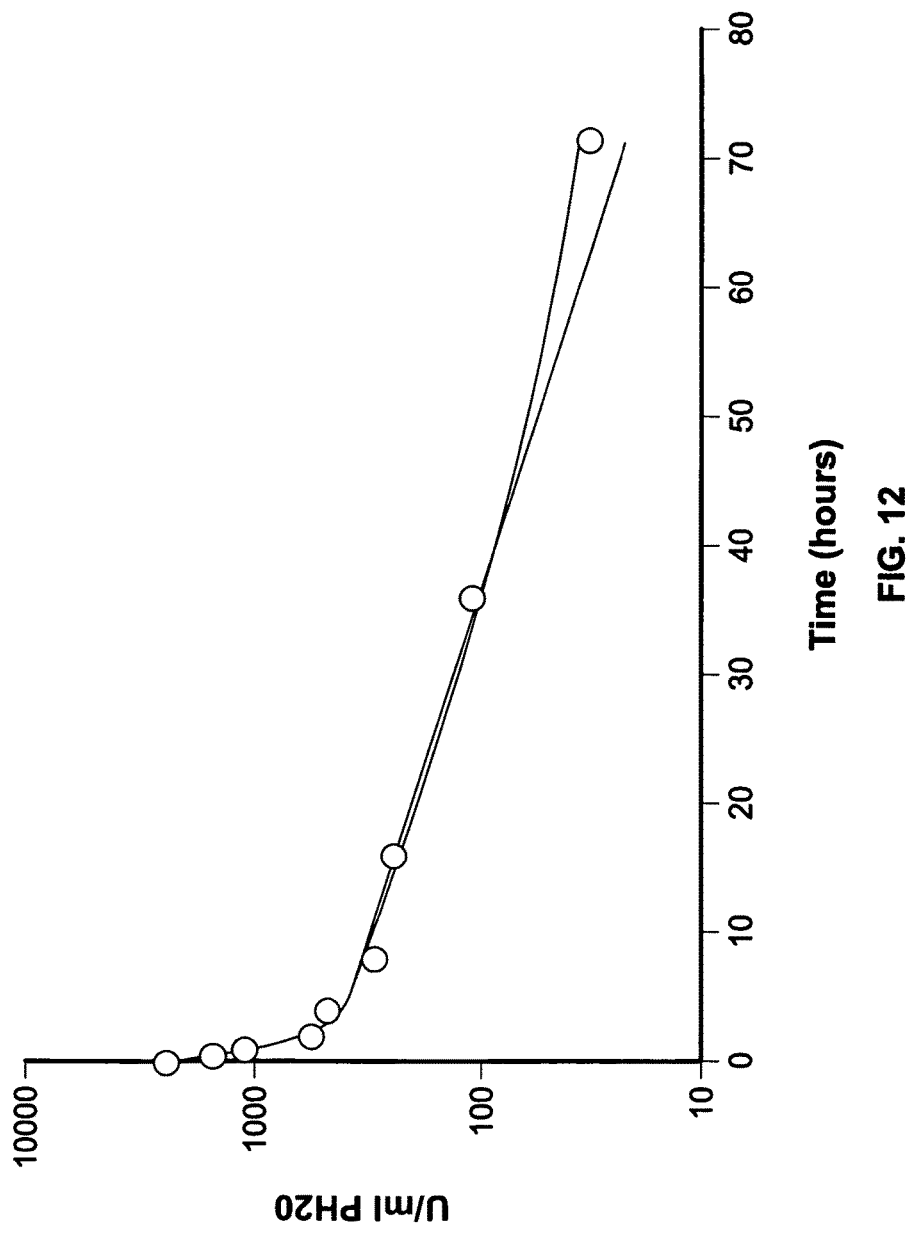
FIG. 12 depicts a PK regression curve after administration of PEGylated rHuPH20 in mice.

The results of the studies above, derived by 2-compartment modeling of concentration-time data, are set forth in Table 42, below, where the PK parameter descriptions are set forth in Table 43, T½ alpha is the distribution phase half-life, T½ beta is the elimination phase half-life, and MRT is the mean residence time. In mice, the alpha phase (distribution phase) half life and the beta phase (elimination phase) half life of the enzyme in the plasma were 0.696 hours and 19.23 hours, respectively. The results in mice are presented in FIG. 12, where initial rapid degradation of plasma hyaluronidase is observed (distribution phase) followed by a slow gradual decay over time (elimination phase). In rats, the alpha phase (distribution phase) half life and the beta phase (elimination phase) half life of the enzyme in the plasma were 1.13 hours and 7.48 hours, respectively. In Cynomolgus monkeys, the alpha phase (distribution phase) half life and the beta phase (elimination phase) half life of the enzyme in the plasma were 1.13 hours and 21.75 hours, respectively.

TABLE 42

Median PK Parameters of PEG-rHuPH20 in Mouse, Rat, and Cynomolgus Monkeys (Derived by 2-Compartment Modeling of Concentration-Time Data)

|  | Mouse | Rat | Cyno Mk |
| --- | --- | --- | --- |
| Body Wt. (kg) | 0.026 | 0.292 | 1.920 |
| BSA (m²) | 0.0079 | 0.0419 | 0.1539 |
| $V_1$ (mL/kg) | 38.44 | 72.00 | 55.83 |
| k10 (1/hr) | 0.161 | 0.384 | 0.046 |
| k12 (1/hr) | 0.65 | 0.15 | 0.31 |
| k21 (1/hr) | 0.22 | 0.15 | 0.40 |
| CL (mL/h-kg) | 6.20 | 30.33 | 2.54 |
| $CL_2$ (mL/h-kg) | 24.91 | 11.52 | 17.60 |
| $V_2$ (mL/kg) | 112.03 | 85.66 | 17.63 |
| T½ α (h) | 0.696 | 1.13 | 1.13 |
| T½ β (h) | 19.23 | 7.48 | 21.75 |
| MRT (h) | 24.32 | 5.81 | 30.76 |

TABLE 43

PK Parameter descriptions

| PK Parameter | Description |
| --- | --- |
| $CL_1$ | Clearance from the Central Compartment (mL/h-kg) |
| $CL_2$ or $Q_D$ | Distribution rate (mL/h-kg) |

TABLE 43-continued

PK Parameter descriptions

| PK Parameter | Description |
| --- | --- |
| k10 | Elimination rate constant (h$^{-1}$) |
| k12 | Distribution rate constant from the Central to Peripheral Compartment (h$^{-1}$) |
| k21 | Distribution rate constant from the Peripheral to Central Compartment (h$^{-1}$) |
| $V_1$ | Volume of the Central Compartment (mL/kg) |
| $V_2$ | Volume of the Peripheral Compartment (mL/kg) |

Example 20

Pharmacokinetic Analysis of Plasma Hyaluronidase Levels after Single Dose Intravenous Administration of PEGPH20

Pharmacokinetic (PK) studies were conducted in ICR mice from Harlan (Indianapolis, Ind.) and in Sprague-Dawley rats (Harlan) following single dose administration of PEGPH20. Following injection of PEGPH20 as described below, plasma levels of PEGPH20 were determined by measuring hyaluronidase activity using a modified turbidometric assay as described in Example 2. Briefly, plasma samples containing hyaluronidase were incubated with hyaluronate (HA) for 60 minutes. Undigested HA was precipitated with the addition of acidified serum. The turbidity of the resulting sample was measured at 640 nm after a 30 minute development period, and the resulting turbidity was a measure of the hyaluronidase activity present. The assay was run under pH conditions that suppress endogenous lysosomal hyaluronidase activity in plasma, which normally exhibits activity at acidic pH. PEGPH20 concentrations were expressed as units of hyaluronidase activity (U)/mL as interpolated from a calibration curve, or as µg/mL calculated using the specific activity (in U/mg) of the PEGPH20 lot. Generally, for rats, the lower level of quantitation was 10 U/mL and the assay was applicable to measuring up to 100 u/mL hyaluronidase activity.

A. Mice

Male ICR mice (3/group) received a single IV dose (125,000 U/kg; 3.3 mg/kg) of PEGPH20 and plasma samples were collected at selected intervals from 5 minutes to 24 hours post-dose. Plasma samples were analyzed for hyaluronidase activity as described above. The results show that following IV injection, the plasma concentration of PEGPH20 declined in a biphasic manner. The initial rapid decline represented distribution from the systemic circulation and was followed by a slower decrease representing the elimination phase. Pharmacokinetic parameters derived from non-compartmental analysis of the hyaluronidase activity over time are set forth in Table 44. The Values are mean data derived from 3 mice using non-compartmental analysis. The data show that the elimination half-life ($t_{1/2}$ λz) of PEGPH20 was approximately 10 hours. The mean volume of distribution ($V_z$) was approximately 122 mL/kg, which is approximately twice the expected plasma volume in mice (i.e. 50 mL/kg; Davies and Morris 1993), suggesting that PEGPH20 was not widely distributed to peripheral tissues.

TABLE 44

Mean PK Parameters After Single IV Dose (125,000 U/kg; 3.3 mg/kg) Administration of PEGPH20 to Male Mice

| PK Parameter | Value |
|---|---|
| $C_0$ (U/mL) | 1,898 |
| $C_0$ (μg/mL) | 50.0 |
| $C_{max}$ (U/mL) | 1,727 |
| $C_{max}$ (μg/mL) | 45.5 |
| $t_{1/2}$ λz (h) | 10.3 |
| $AUC_{0-\infty}$ (U·h/mL) | 15,244 |
| $AUC_{0-\infty}$ (μg·h/mL) | 401 |
| $V_z$ (mL/kg) | 121.8 |
| $V_{ss}$ (mL/kg) | 109.7 |
| CL (mL/h · kg) | 8.2 |
| MRT (h) | 13.4 |

PK = pharmacokinetic;
U = units of enzymatic activity;
IV = intravenous;
$C_0$ = plasma concentration back-extrapolated to time 0;
$C_{max}$ = maximum observed plasma concentration;
$t_{1/2}$ λz = terminal half-life;
$AUC_{0-\infty}$ = area under the plasma concentration versus time curve from time 0 and extrapolated to infinity;
$V_z$ = volume of distribution;
$V_{ss}$ = volume of distribution at steady state;
CL = absolute clearance; MRT = mean residence time B. Rats Male Sprague-Dawley rats (3/group) received a single IV dose (125,000 U/kg; 3 mg/kg) of PEGPH20 and plasma samples were collected at selected intervals from 5 minutes to 96 hours post-dose. Plasma samples were analyzed for hyaluronidase activity as described above. The results show that following IV injection, the plasma concentration of PEGPH20 declined in a biphasic manner. The initial rapid decline represented a distribution from the systemic circulation and was followed by a slower decrease representing the elimination phase. Pharmacokinetic parameters derived from non-compartmental analysis of the hyaluronidase activity over time are set forth in Table 45. The Values are mean data derived from 3 rats using non-compartmental analysis. The data show that the elimination half-life ($t_{1/2}$, λz) of PEGPH20 was approximately 8 hours, which was more rapid than seen in mice. This was also reflected in a shorter mean residence time (MRT) and faster absolute clearance (CL) than observed in mice. The mean volume of distribution ($V_z$) was approximately 296 mL/kg, which is greater than the expected plasma volume in rats (i.e. 31 mL/kg; Davies and Morris 1993), and approximates the expected extracellular fluid volume in rats (i.e. 297 mL/kg; Davies and Morris 1993).

TABLE 45

Mean PK Parameters After Single IV Dose (125000 U/kg; 3 mg/kg) Administration of PEGPH20 to Male Rats

| PK Parameter | Value |
|---|---|
| $C_0$ (U/mL) | 1,228 |
| $C_0$ (μg/mL) | 30.0 |
| $C_{max}$ (U/mL) | 1,256 |
| $C_{max}$ (μg/mL) | 30.6 |
| $t_{1/2}$ λz (h) | 7.7 |
| $AUC_{0-\infty}$ (U·h/mL) | 4,713 |
| $AUC_{0-\infty}$ (μg·h/mL) | 115 |
| $V_z$ (mL/kg) | 296.1 |
| $V_{ss}$ (mL/kg) | 174.9 |
| CL (mL/h · kg) | 26.6 |
| MRT (h) | 6.6 |

PK = pharmacokinetic;
U = units of enzymatic activity;
IV = intravenous;
$C_0$ = plasma concentration back-extrapolated to time 0;
$C_{max}$ = maximum observed plasma concentration;
$t_{1/2}$ λz = terminal half-life;
$AUC_{0-\infty}$ = area under the plasma concentration versus time curve from time 0 and extrapolated to infinity;
$V_z$ = volume of distribution;
$V_{ss}$ = volume of distribution at steady state;
CL = absolute clearance;
MRT = mean residence time C. Summary In single intravenous dose studies in mice and rats, plasma hyalurondiase activity declined in a biphasic manner, with a rapid initial distribution phase and a slower elimination phase. Mean elimination half-lives ($t_{1/2}$) were approximately 10 hours in mice and 8 hours in rats. The mean volume of distribution ($V_z$) was 122 mL/kg for mice, suggesting that PEGPH20 was not widely distributed into peripheral tissues in mice. The mean Vz was higher in rats at 296 mL/kg.

Example 21

Dose Range and Pharmacokinetic Study of PEGPH20 Following a Single Intravenous Dose Administration in Cynomolgus Monkeys Pharmacokinetic (PK) studies were conducted in Cynomolgus Monkeys following single dose administration of PEGPH20 at various dose ranges. Following injection of PEGPH20 as described below, plasma levels of PEGPH20 were determined by measuring hyalurondiase activity using a modified turbidometric assay as described in Example 20. As with rats, the lower level of quantitation was 10 U/mL and the assay was applicable to measuring up to 100 u/mL hyaluronidase activity.

Male cynomolgus monkeys (1 to 5/group) received a single IV dose of PEGPH20 at concentrations ranging from 1 mg/kg (38,000 U/kg), 3 mg/kg (114,000 U/kg), 6 mg/kg (228,000 U/kg), 12.5 mg/kg (412,500 U/kg) and 33 mg/kg (1,089,000 U/kg) and plasma samples were collected at selected intervals from 0.5 to 72 hours post-dose. Plasma samples were analyzed for hyaluronidase activity as described above. The results show that the decline in plasma concentration was monophasic because the rapid distribution phase was not captured with the first PK blood collection time at 0.5 hours post-dose. Pharmacokinetic parameters derived from non-compartmental analysis of the hyaluronidase activity over time are set forth in Table 46. The Values are mean data derived from 1 to 5 monkeys using non-compartmental analysis as set forth in the Table.

The data show that the elimination half-life ($t_{1/2}$ λz) of PEGPH20 was ranged from 39 to 53 hours (1.6 to 2.2 days). The long half-life resulted from a slow systemic clearance of approximately 1.0 mL/h kg. Maximum plasma concentration as determined by back extrapolation to time immediately after IV injection [$C_0$], terminal elimination rate $k_{\lambda z}$, and absolute clearance (CL) provided estimates of the volume of distribution ($V_z$). The range of the mean $V_z$ was from 70 to 93 mL/kg, which is approximately twice the expected plasma volume in monkeys (i.e. 45 mL/kg; Davies and Morris 1993), suggesting that PEGPH20 was not widely distributed to peripheral tissues.

Dose linearity was examined using area under the plasma concentration-time curve, the extrapolated maximal concentration [$C_0$], and the observed $C_{max}$. Correlation of log-transformed PK parameters with log-transformed IV dose revealed linear relationships with slopes equal to 1.0, suggesting that the PK of PEGPH20 in monkeys was linear with respect to dose. Systemic exposure and observed maximal plasma concentration increased proportionally with increases in dose.

TABLE 46

Mean PK Parameters After Single IV Dose Administration of PEGPH20 to Male Monkeys

| | Value | | | | |
|---|---|---|---|---|---|
| Dose (U/kg): | 38,000 | 114,000 | 228,000 | 412,500 | 1,089,000 |
| Dose (mg/kg): | 1 | 3 | 6 | 12.5 | 33 |
| N: | 3 | 3 | 5 | 1 | 1 |
| PK Parameter | | | | | |
| $C_0$ (U/mL) | 813 | 1,653 | 4,558 | 6,320 | 18,601 |
| $C_0$ (µg/mL) | 21.4 | 43.5 | 119.9 | 191.5 | 563.7 |
| $C_{max}$ (U/mL) | 712 | 1,763 | 4,503 | 5,770 | 17,084 |
| $C_{max}$ (µg/mL) | 18.8 | 46.4 | 118.5 | 174.9 | 517.7 |
| $t_{1/2}$ λz (h) | 39.7 | 49.1 | 41.0 | 53.2 | 52.3 |
| $AUC_{0-\infty}$ | 23,654 | 88,630 | 195,117 | 372,399 | 961,009 |
| $AUC_{0-\infty}$ | 622 | 2,332 | 5,135 | 11,285 | 29,121 |
| $V_z$ (mL/kg) | 92.5 | 92.8 | 70.0 | 85.0 | 85.6 |
| $V_{ss}$ (mL/kg) | 81.7 | 86.6 | 66.2 | 81.2 | 81.7 |
| CL (mL/h · kg) | 1.6 | 1.4 | 1.2 | 1.1 | 1.1 |
| MRT (h) | 50.9 | 66.6 | 56.0 | 73.3 | 72.1 |

PK = pharmacokinetic;
U = units of enzymatic activity;
IV = intravenous;
$C_0$ = plasma concentration back-extrapolated to time 0;
$C_{max}$ = maximum observed plasma concentration;
$t_{1/2}$ λz = terminal half-life;
$AUC_{0-\infty}$ = area under the plasma concentration versus time curve from time 0 and extrapolated to infinity;
$V_z$ = volume of distribution;
$V_{ss}$ = volume of distribution at steady state;
CL = absolute clearance;
MRT = mean residence time Summary In single intravenous dose studies in monkeys, plasma hyalurondiase activity declined in a biphasic manner, with a rapid initial distribution phase and a slower elimination phase. Mean elimination half-lives ($t_{1/2}$) was approximately 40 to 53 hours in monkeys. The mean volume of distribution ($V_z$) was 70 to 93 mL/kg for monkeys, suggesting that PEGPH20 was not widely distributed into peripheral tissues. In the monkey study evaluating several dose levels of PEGPH20, the maximum observed plasma concentration ($C_{max}$) and area under curve for plasma concentration versus time (AUC) increased linearly with increasing PEGPH20 dose.

Example 22

Repeated Dose

Pharmacokinetic (PK) and/or toxicology (TK) studies were conducted in Sprague-Dawley rats (Harlan) and cynomolgus monkeys following repeat dose administration of PEGPH20. Plasma hyaluronidase levels were determined as described in Example 20.

A. Rats

A 4-week repeat-dose toxicity study was conducted in Sprague-Dawley rats following IV administration of PEGPH20. Four groups of 3 rats/gender/group received intravenous twice-weekly doses of the vehicle (10 mM Hepes pH 7.0+130 mM NaCl) or 0.5, 5 or 25 mg/kg of PEGPH20, respectively, for 4 consecutive weeks. Blood samples were collected from each animal on Days 1 and 25 at predetermined times post-dosing. Plasma samples were analyzed for hyaluronidase activity as described in Example 20. Toxicokinetic parameters were derived for each IV dose using non-compartmental modeling of the plasma concentration-versus-time data. The derived TK parameters are set forth in Table 47. Analysis of plasma concentration versus time after twice-weekly IV dose administration of PEGPH20 showed that exposures ($C_{max}$ and AUC) increased with increasing PEGPH20 dose. Toxicokinetics were approximately linear over the range of doses evaluated. Elimination half-life ($t_{1/2}$) increased with increasing PEGPH20 dose. Exposures were generally similar between genders for any given dose level and dosing day. Following repeated IV dosing of PEGPH20, there was a trend toward increased AUC on Day 25 compared with Day 1 in the 5 mg/kg and 25 mg/kg dose groups. However, Day 25 AUC exposures remained <2-fold the exposures observed on Day 1 within any given dose group. Exposures as determined by $C_{max}$ generally remained consistent from Day 1 to Day 25 within any given dose group.

TABLE 47

Mean TK Parameters After Twice - Weekly IV Administration of PEGPH20 to Rats for 4 Consecutive Weeks

| | 0.5 mg/kg | | 5 mg/kg | | 25 mg/kg | |
|---|---|---|---|---|---|---|
| Parameter | Day 1 | Day 25 | Day 1 | Day 25 | Day 1 | Day 25 |
| | Males | | | | | |
| $C_{max}$ (U/mL) | 174 | 203 | 1,760 | 2,490 | 11,500 | 10,900 |
| $t_{1/2}$ (h) | 2.90 | 3.28 | 8.71 | 23.9 | 12.6 | 24.0 |
| $AUC_{0-t}$ (U · h/mL) | 674 | 695 | 12,000 | 20,700 | 100,000 | 195,000 |
| $C_{max}$ Exposure Ratio ($C_{max}$ on Day 25/$C_{max}$ on Day 1) | 1.17 | | 1.41 | | 0.95 | |

TABLE 47-continued

Mean TK Parameters After Twice - Weekly IV Administration of PEGPH20 to Rats for 4 Consecutive Weeks

| Parameter | 0.5 mg/kg | | 5 mg/kg | | 25 mg/kg | |
|---|---|---|---|---|---|---|
| | Day 1 | Day 25 | Day 1 | Day 25 | Day 1 | Day 25 |
| AUC Exposure Ratio ($AUC_{0-t}$ on Day 25/$AUC_{0-t}$ on Day 1) | 1.03 | | 1.73 | | 1.95 | |
| Females | | | | | | |
| $C_{max}$ (U/mL) | 196 | 171 | 1,830 | 1,960 | 10,300 | 10,100 |
| $t_{1/2}$ (h) | 2.42 | 3.75 | 9.43 | 13.3 | 11.6 | 21.1 |
| $AUC_{0-t}$ (U · h/mL) | 491 | 608 | 10,300 | 13,400 | 105,000 | 154,000 |
| $C_{max}$ Exposure Ratio ($C_{max}$ on Day 25/$C_{max}$ on Day 1) | 0.87 | | 1.07 | | 0.98 | |
| AUC Exposure Ratio ($AUC_{0-t}$ on Day 25/$AUC_{0-t}$ on Day 1) | 1.24 | | 1.30 | | 1.47 | |
| $C_{max}$ Gender Ratio ($C_{max}$ (males)/$C_{max}$ (females)) | 0.89 | 1.19 | 0.96 | 1.27 | 1.12 | 1.08 |
| AUC Gender Ratio ($AUC_{0-t}$ (males)/$AUC_{0-t}$ (females)) | 1.37 | 1.14 | 1.17 | 1.54 | 0.95 | 1.27 |

TK = toxicokinetic;
IV = intravenous;
U = units of enzymatic activity;
$C_{max}$ = maximum observed plasma concentration;
$t_{1/2}$ = elimination half-life;
$AUC_{0-t}$ = area under the plasma concentration versus time curve from time 0 to the last measured time point The twice-weekly IV administration was well tolerated in rats. There was a transient decrease in body weight, which returned towards pre-study values by the end of the dosing period. This effect was attributed to PEGPH20 pharmacology as a decrease in extracellular hyaluronan and its associated water. There was a modest prolongation of activated partial thromboplastin time (APTT), although prothrombin time was unchanged. There was no hemorrhage observed performed grossly at necropsy or microscopically in any tissue examined. Thus, due to the assessment that APTT prolongation was an adverse event in rats, the no observed adverse effect level (NOAEL) was defined as 5 mg/kg/dose in rats. No changes in food consumption or behavior was observed. Since no other test article-related findings were observed, the mg/kg/dose would be the designated NOAEL, except for the prolonged APTT observed.

B. Monkeys

1. Repeat Dose Toxicity Study

Female cynomolgus monkeys (N=3) received a 6 mg/kg (198,000-222,000 U/kg) IV dose of PEGPH20 on study days 1, 3, 8, 11, 15, 22, 25, and 29. Plasma samples were collected at selected intervals from 0.083 to 96 hours post-dose on Days 1, 3, 8, 11 and 25. Plasma samples were analyzed for hyaluronidase activity using a micro-turbidity plate assay as described in Example 20. Toxicokinetic parameters were derived for each IV dose using non-compartmental modeling of the plasma concentration-versus-time data. Each dose was modeled independently of the previous sequential dose. The results are shown in Table 48. TK analysis of the plasma concentration-versus-time data after repeated IV dose administration of PEGPH20 to female monkeys showed that the decline in plasma concentration following IV injection of a 6 mg/kg (~210,000 U/kg) dose of PEGPH20 was bi-phasic. There was a rapid initial decline in concentration followed by a slower decrease in concentration with time. Estimates of the volume of distribution ($V_z$) suggested that PEGPH20 was not extensively distributed to peripheral tissues. The systemic clearance of PEGPH20 was slow with mean rate ranging from 0.9 to 1.6 mL/h-kg as determined on Study Days 1, 3, 8, and 11. The slow clearance contributed to a long elimination half-life ($t_{1/2}$ λz). The observed mean elimination half-life ($t_{1/2}$ λz) for PEGPH20 ranged from 28 to 64 hours (1.2 to 2.7 days). An accelerated clearance for PEGPH20 was observed in two of three animals on study day 25. Plasma samples collected on study day 25 were re-assayed to confirm PEGPH20 concentrations and the mean concentrations were reported.

TABLE 48

TK Parameters After Repeat IV Dose Administration of PEGPH20

| TK Parameter | Animal No. | Day | | | | |
|---|---|---|---|---|---|---|
| | | 1 | 3 | 8 | 11 | 25 |
| $C_0$ (U/mL) | 1 | 5,044 | 4,915 | 4,395 | 5,170 | 4,209 |
| | 2 | 5,090 | 5,722 | 3,245 | 3,142 | 4,233 |
| | 3 | 4,338 | ND | 3,517 | 4,649 | 5,851 |
| | Mean | 4,824 | 5,319 | 3,719 | 4,320 | 4,765 |

TABLE 48-continued

TK Parameters After Repeat IV Dose Administration of PEGPH20

| TK Parameter | Animal No. | Day 1 | Day 3 | Day 8 | Day 11 | Day 25 |
|---|---|---|---|---|---|---|
| $C_0$ (μg/mL) | 1 | 144.1 | 140.4 | 125.6 | 147.7 | 120.3 |
| | 2 | 145.4 | 163.49 | 92.7 | 89.8 | 121.0 |
| | 3 | 123.9 | ND | 100.5 | 132.8 | 167.2 |
| | Mean | 137.8 | 152.0 | 106.3 | 123.4 | 136.1 |
| $C_{max}$ (U/mL) | 1 | 4,762 | 4,620 | 4,002 | 4,836 | 4,006 |
| | 2 | 4,986 | 5,361 | 3,578 | 3,038 | 4,070 |
| | 3 | 4,143 | ND | 3,243 | 4,309 | 5,832 |
| | Mean | 4630 | 4,991 | 3,608 | 4,061 | 4,636 |
| $C_{max}$ (μg/mL) | 1 | 136.1 | 132.0 | 114.3 | 138.2 | 114.5 |
| | 2 | 142.5 | 153.2 | 102.2 | 86.8 | 116.3 |
| | 3 | 118.4 | ND | 92.7 | 123.1 | 166.6 |
| | Mean | 132.3 | 142.6 | 103.1 | 116.0 | 132.5 |
| $t_{1/2} \lambda z$ (h) | 1 | 33.4 | 40.7 | 66.6 | 48.9 | 10.0 |
| | 2 | 30.2 | 49.0 | 62.3 | 63.4 | 14.0 |
| | 3 | 33.7 | ND | 63.8 | 51.3 | 60.2 |
| | Mean | 32.5 | 44.8 | 64.2 | 54.5 | 28.1 |
| $AUC_{0-\infty}$ (U·h/mL) | 1 | 140,017 | 207,696 | 209,290 | 169,919 | 62,524 |
| | 2 | 147,554 | 269,928 | 234,010 | 169,380 | 67,016 |
| | 3 | 135,337 | ND | 159,178 | 153,185 | 366,069 |
| | Mean | 140,969 | 238,812 | 200,826 | 164,162 | 165,203 |
| $AUC_{0-\infty}$ (μg·h/mL) | 1 | 4,000 | 5,934 | 5,980 | 4,855 | 1,786 |
| | 2 | 4,216 | 7,712 | 6,686 | 4,839 | 1,915 |
| | 3 | 3,867 | ND | 4,548 | 4,377 | 10,459 |
| | Mean | 4,028 | 6,823 | 5,738 | 4,690 | 4,720 |
| $V_z$ (mL/kg) | 1 | 76.5 | 62.7 | 101.9 | 92.1 | 45.8 |
| | 2 | 65.6 | 58.2 | 85.2 | 119.9 | 59.6 |
| | 3 | 79.8 | ND | 128.4 | 107.2 | 47.0 |
| | Mean | 74.0 | 60.4 | 105.2 | 106.4 | 50.8 |
| $V_{ss}$ (mL/kg) | 1 | 75.8 | 61.5 | 99.4 | 90.1 | 49.8 |
| | 2 | 64.9 | 57.2 | 83.9 | 118.6 | 58.9 |
| | 3 | 79.8 | ND | 124.9 | 104.8 | 46.3 |
| | Mean | 73.5 | 59.3 | 102.7 | 104.5 | 51.6 |
| CL (mL/h·kg) | 1 | 1.59 | 1.07 | 1.06 | 1.31 | 3.17 |
| | 2 | 1.50 | 0.82 | 0.95 | 1.31 | 2.95 |
| | 3 | 1.64 | ND | 1.39 | 1.45 | 0.54 |
| | Mean | 1.58 | 0.95 | 1.13 | 1.36 | 2.22 |
| MRT (h) | 1 | 47.8 | 57.5 | 93.7 | 69.0 | 15.7 |
| | 2 | 43.1 | 69.5 | 88.4 | 90.5 | 19.9 |
| | 3 | 48.6 | ND | 89.6 | 72.3 | 85.6 |
| | Mean | 46.5 | 63.5 | 90.6 | 77.3 | 40.4 |

TK = toxicokinetic;
IV = intravenous;
U = units of enzymatic activity;
$C_0$ = plasma concentration back-extrapolated to time 0;
ND = not determined;
$C_{max}$ = maximum observed plasma concentration;
$t_{1/2} \lambda z$ = terminal half-life;
$AUC_{0-\infty}$ = area under the plasma concentration versus time curve from time 0 and extrapolated to infinity;
$V_z$ = volume of distribution;
$V_{ss}$ = volume of distribution at steady state;
CL = absolute clearance;
MRT = mean residence time 2. Four-Week Repeat Intravenous Dose Toxicity Study A 4-week repeat-dose toxicity study was conducted in cynomolgus following IV administration of PEGPH20. Four groups of monkeys (6 animals per gender, with the exception of the group that received 0.2 mg/kg/dose of PEGPH20, which was 4 animals per gender) received IV twice-weekly doses of vehicle, 0.2, 2.0 or 10.5 mg/kg/dose of PEGPH20, respectively, for 4 consecutive weeks. Blood samples were collected from each animal on Days 1 and 25 at pre-dose and at 0.5, 1, 2, 4, 8, 12, 24, 48 and 72 hours post-dose. Additional blood samples were collected on Days 4, 8, 11, 15, 18 and 22 at pre-dose and at two minutes post-dose. Plasma samples were analyzed for hyaluronidase activity using turbidometric assay described in Example 20. Toxicokinetic parameters were derived for each IV dose using non-compartmental modeling of the plasma concentration-versus-time data. The results are set forth in Table 49. TK analysis of the plasma concentration-versus-time data after twice-weekly IV dose administration of PEGPH20 to monkeys for 4 consecutive weeks demonstrated that exposures ($C_{max}$ and AUC) increased with increasing PEGPH20 dose. Toxicokinetics were approximately linear over the range of doses evaluated. Elimination half-life ($t_{1/2}$) increased with increasing PEGPH20 dose. On repeated dosing, $t_{1/2}$ decreased in the low- and mid-dose males. Exposure data for the low-dose also showed animals with loss of exposure on repeated dosing. Exposures were generally similar between genders for any given dose level and dosing day. Following repeated IV dosing of PEGPH20, there was a trend toward increased $C_{max}$ and AUC on Day 25 compared with Day 1 in the 2 mg/kg and 10.5 mg/kg dose groups. However, Day 25 AUC exposures remained <2-fold the exposures observed on Day 1 within any given dose group. A loss of exposure for PEGPH20 was observed in the 0.2 mg/kg group in 3 of 8 animals on Study Day 25.

C. Summary

In a repeat IV dose in monkeys in which a 6 mg/kg (approximately 210,000 U/kg) dose of PEGPH20 was administered 8 times over a 29-day period, exposures (as assessed by mean $C_{max}$ and AUC values) were similar over the study period. The systemic clearance (CL) of PEGPH20 was slow with mean rates of 0.9 to 1.6 mL/h kg. The slow clearance contributed to a long elimination half-life, which ranged from 28 to 64 hours (1.2 to 2.7 days).

The toxicology studies in rats and monkeys, in which animals received PEGPH20 at varying doses twice-weekly for 4 consecutive weeks, showed that exposures ($C_{max}$ and AUC values) increased linearly with increase dose and elimination half-life increased with increasing dose. The mean values of elimination half-life in rats ranged from approximately 3 hours (0.5 mg/kg dose) to 24 hours (25 mg/kg dose) and in monkeys ranged from 17 hours (0.2 mg/kg dose) to 78 hours (10.5 mg/kg dose). In both species, exposures were generally similar between genders for any given dose level and dosing day. A loss of exposure, however, was observed in the 0.2 mg/kg group in 3 of 8 animals on Day 25. In rats, there was a trend toward increased AUC on Day 25 compared with Day 1 in the 5 mg/kg and 25 mg/kg dose groups, nevertheless, day 25 AUC exposures

TABLE 49

Mean TK Parameters After Twice - Weekly IV Administration of

| Parameter | 0.2 mg/kg | | 2 mg/kg | | 10.5 mg/kg | |
| --- | --- | --- | --- | --- | --- | --- |
| | Day 1 | Day 25 | Day 1 | Day 25 | Day 1 | Day 25 |
| Males | | | | | | |
| $C_{max}$ (U/mL) | 114 | 92.5 | 1,130 | 1,330 | 6,410 | 9,490 |
| $t_{1/2}$ (h) | 33.5 | 17.0 | 40.9 | 16.7 | 50.1 | 78.1 |
| $AUC_{0-t}$ | 2,750 | 1,790 | 32,500 | 36,200 | 225,000 | 429,000 |
| $C_{max}$ Exposure Ratio (Cmax on Day 25/Cmax on Day 1) | 0.77 | | 1.18 | | 1.48 | |
| AUC Exposure Ratio (AUC0-t on Day 25/AUC0-t on Day 1) | 0.65 | | 1.11 | | 1.91 | |
| Females | | | | | | |
| $C_{max}$ (U/mL) | 113 | 97.3 | 1,310 | 1,560 | 6,450 | 8,340 |
| $t_{1/2}$ (h) | 29.0 | 42.0 | 37.7 | 44.8 | 51.1 | 42.4 |
| $AUC_{0-t}$ (U · h/mL) | 2,650 | 1,680 | 35,600 | 56,300 | 230,000 | 332,000 |
| $C_{max}$ Exposure Ratio ((Cmax on Day 25/Cmax on Day 1) | 0.74 | | 1.19 | | 1.29 | |
| AUC Exposure Ratio ((AUC0-t on Day 25/AUC0-t on Day 1) | 0.61 | | 1.58 | | 1.44 | |
| $C_{max}$ Gender Ratio(Cmax (males)/Cmax (females)) | 1.01 | 0.95 | 0.86 | 0.85 | 0.99 | 1.14 |
| AUC Gender Ratio (AUC0-t (males)/AUC0-t (females)) | 1.04 | 1.07 | 0.91 | 0.64 | 0.98 | 1.29 |

TK = toxicokinetic;
IV = intravenous;
U = units of enzymatic activity;
$C_{max}$ = maximum observed plasma concentration;
$t_{1/2}$ = elimination half-life;
$AUC_{0-t}$ = area under the plasma concentration versus time curve from time 0 to the last measured time point The twice-weekly IV administration was well tolerated in monkeys. Like rats, there was a transient decrease in body weight, which returned towards pre-study values by the end of the dosing period. Unlike rats, there was no prolonged APTT and the only change in coagulation parameters was limited to a transient and dose-independent increase in plasma fibrinogen, which is consistent with a transient acute-phase response to PEGPH20 administration. Changes in limb joints were observed in monkeys, with a dose-related decrease in range of motion at the knee and elbow, which showed partial to full recovery following cessation of dosing. Also, there was a moderate decrease in soft tissue mass (skeletal muscle) in a single high-dose animal observed by radiologic examination. This is consistent with the pharmacologic effect of PEGPH20 to remove hyaluronan and its associated extracellular water from tissues. There was no associated histopathologic changes of the knee joint or skeletal muscle, nor abnormal radiography findings of the knee joint itself. No changes in food consumption or behavior were observed. Since no test article-related findings were observed, the high-dose of 10.5 mg/kg/dose was the designated NOAEL monkeys.

remained <2-fold the exposures observed on day 1 within any given dose group. Exposures as determined by $C_{max}$ generally remained consistent from Day 1 to Day 25 within any given dose group in rats. In monkeys, there was a trend toward increased $C_{max}$ and AUC on Day 25 compared with Day 1 in the 2 mg/kg and 10.5 mg/kg dose groups. Similar to rats, Day 25 AUC exposures in monkeys remained <2-fold the exposures observed on Day 1 within any given dose group.

Example 23

Allometric Scaling Model

Single-dose intravenous pharmacokinetic studies in mice, rats and monkeys described in Example 20 formed the basis of an allometric scaling model applicable to large molecules that are retained largely within the vascular system, which was used to estimate the pharmacologically active dose (PAD) and the dosing frequency for PEGPH20 in humans. Due to the large molecular size of PEGPH20 (molecular weight is estimated to be between 100 and 270 kDa), the conventional Interspecies Scaling Factor technique used for small molecules is not applicable to molecules confined to the intravascular compartment.

Allometric modeling was performed from the PK parameters observed in mice, rats and monkeys by scaling the parameters allometrically to the animals' body surface area and to the animals' body weight. Derived interspecies allometric relationships were used to calculate/predict primary PK parameters for humans. The parameters calculated were systemic clearance (CL), peripheral clearance ($CL_2$), volume of the central compartment ($V_1$), volume of the peripheral compartment ($V_2$), elimination rate constant from the central compartment (k10), and the distribution rate constants between the central and peripheral compartment (k12 and k21). With the assumption of proportional increase in systemic exposure with increases of IV dose, the concentration-time profiles for PEGPH20 in humans were simulated with a 2-compartment model for IV dose levels of 1500, 3,000, 6,000, 12,000, 24,000 and 48,000 U/kg. Twice-a-week (BIW) dose administrations of Monday-Thursday or Monday-Friday schedule were examined and demonstrated that clinical doses ≥1,500 U/kg (50 µg/kg) and a Monday-Thursday BIW dose schedule are projected to maintain a threshold plasma concentration (Ctrough) above the pharmacologically effective concentration of ≥10 U/mL.

The human dose of 0.05 mg/kg is consistent with the conventional 1/10 safety factor for rodents where the 5 mg/kg dose level was defined as the NOAEL in rats. The lowest dose in the monkey study was 0.2 mg/kg and the highest does was 10.5 mg/kg. Taking these two dose levels, respectively, and noting that they were not associated with adverse events, the human dose of 0.05 mg/kg represents a 4-fold and 210-fold safety factor vs. doses administered to primates.

Since modifications will be apparent to those of skill in this art, it is intended that this invention be limited only by the scope of the appended claims.

SEQUENCE LISTING (189 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  sHuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  sHuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  sHuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  sHuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  sHuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  sHuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  sHuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  sHuPH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  sHuPH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
  PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus (strain COL); identical to SEQ ID NO: 33
  hyaluronan lyase

SEQ ID NO: 75 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus (strain NCTC 8325); identical to SEQ ID NO: 33
  hyaluronan lyase

SEQ ID NO: 79 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus (strain USA300); identical to SEQ ID NO: 33
  hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae serotype 2 (strain D39/N)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes serotype M2 (strain MGAS10)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes serotype M4 (strain MGAS10)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes serotype M12 (strain MGAS2)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes serotype M12 (strain MGAS2)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes serotype M12 (strain MGAS9)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  Mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

The invention claimed is:

1. A method for treating a tumor with a PEGylated soluble human PH20 hyaluronidase in a subject having pancreatic cancer, comprising:
   a) measuring the expression or level of hyaluronan in a tumor sample from the subject, wherein the subject has pancreatic cancer; and the tumor sample is a pancreatic tumor biopsy sample;
   b) determining the level of expression of hyaluronan in the tumor biopsy sample;
   c) identifying, for treatment, the subject, wherein hyaluronan is expressed in at least 30% of the tumoral area in the tumor biopsy sample from the subject; and then
   d) administering to the subject, the PEGylated soluble PH20 hyaluronidase, and administering a second agent that is an anti-cancer agent or treatment for treating the tumor in the subject.

2. The method of claim 1, wherein the hyaluronan is detected with a hyaluronan-binding protein.

3. The method of claim 1, wherein the pancreatic cancer is selected from one or more of a late-stage pancreatic cancer, a metastatic pancreatic cancer or an undifferentiated pancreatic cancer.

4. The method of claim 1, wherein the PEGylated soluble human PH20 hyaluronidase is a C-terminally truncated human PH20 hyaluronidase that lacks all or a portion of a C-terminal GPI anchor.

5. The method of claim 1, wherein the PEGylated soluble PH20 hyaluronidase is:
   a polypeptide consisting of an amino acid sequence having at least 98% amino acid sequence identity with the amino acid sequence of SEQ ID NO: 48, wherein the PEGylated soluble PH20 hyaluronidase is N-glycosylated and neutral active.

6. The method of claim 1, wherein the PEGylated soluble PH20 hyaluronidase consists of the amino acid sequence set forth as amino acids 36-467, 36-468, 36-469, 36-470, 36-471, 36-472, 36-473, 36-474, 36-475, 36-476, 36-477, 36-478, 36-479, 36-480, 36-481, 36-482 or 36-483 of the amino acid sequence of SEQ ID NO: 1, or an amino acid sequence having at least 95% amino acid sequence identity with the amino acid sequence set forth as amino acids 36-467, 36-468, 36-469, 36-470, 36-471, 36-472, 36-473, 36-474, 36-475, 36-476, 36-477, 36-478, 36-479, 36-480, 36-481, 36-482 or 36-483 of the amino acid sequence of SEQ ID NO: 1.

7. The method of claim 1, wherein the PEGylated soluble PH20 hyaluronidase is selected from a polypeptide consisting of the amino acid sequence set forth in SEQ ID NOS: 4-9 and 47-48, or variants thereof that have at least 98% amino acid sequence identity to the amino acid sequence of SEQ ID NO: 48.

8. The method of claim 1, wherein PEGylation results from reaction with a PEG reagent selected from methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-polyethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol)) 2-N-hydroxysuccinimide ester (mPEG2-NHS) (10 kDa branched); (methoxy-poly(ethylene glycol)) 2-N-hydroxysuccinimide ester (mPEG2-NHS) (20 kDa branched); (methoxy-poly(ethylene glycol)) 2-N-hydroxysuccinimide ester (mPEG2-NHS) (40 kDa branched); (methoxy-poly(ethylene glycol)) 2-N-hydroxysuccinimide ester (mPEG2-NHS) (60 kDa branched); biotin-poly(ethylene glycol)-N-hydroxysuccinimide ester (biotin-PEG-NHS) (5 kDa biotinylated); polyethylene glycol)-p-nitrophenyl carbonate (PEG-p-nitrophenyl-carbonate) (30 kDa); or poly(ethylene glycol)-priopionaldehyde (PEG-propionaldehyde) (30 kDa).

9. The method of claim 1, wherein the PEG is a branched or linear PEG.

10. The method of claim 1, wherein the PEG is a methoxy-PEG (mPEG).

11. The method of claim 1, wherein the PEG is a linear N-hydroxysuccinimidyl ester of methoxy poly(ethylene glycol) butanoic acid.

12. The method of claim 1, wherein the PEG has a weight of 30 kilodaltons.

13. The method of claim 1, wherein the PEGylated soluble PH20 hyaluronidase is administered intravenously, subcutaneously, intraperitoneally, or intra-tumorally.

14. The method of claim 1, wherein the PEGylated soluble PH20 hyaluronidase is administered at 10 to 50,000,000 Units.

15. The method of claim 1, wherein the anti-cancer agent or treatment is selected from the group consisting of a chemotherapeutic agent, radiation therapy, an antibody, a peptide, a gene therapy vector, a virus and a nucleic acid.

16. The method of claim 1, wherein the second agent is an anti-cancer agent selected from the group consisting of Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflomithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Flurocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Elydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-gas; Interferon alfa-2bs; Interferon Alfas; Interferon Betas; Interferon Gammas; Interferons; Interleukin-2s and other Interleukins (including recombinant Interleukins); Intoplicines; Iobenguanes [131-1]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafamibs; Losoxantrones; Lurtotecans; Mafosfamides; Mannosulfans; Marimastats; Masoprocols; Maytansines; Mechlorethamines; Meclorethamines/Nitrogen mustards; Megestrol acetates; Megestrols; Melengestrols; Melphalans; MelphalanslL-PAMs; Menogarils; Mepitiostanes; Mercaptopurines; 6-Mecaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolonehenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs;

Rogletimides; Roquinimexs; Rufocromomycins; Sabarubicins; Safingols; Sargramostims; Satraplatins; Sebriplatins; Semustines; Simtrazenes; Sizoftrans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars.

17. The method of claim 1, wherein the second agent and the PEGylated soluble PH20 hyaluronidase are administered in a single composition.

18. The method of claim 1, wherein the second agent and the PEGylated soluble PH20 hyaluronidase are administered separately.

19. The method of claim 1, wherein the second agent and the PEGylated soluble PH20 hyaluronidase are administered simultaneously, sequentially or intermittently in any order.

20. The method of claim 1, wherein the second agent is administered after administration of the PEGylated soluble PH20 hyaluronidase.

21. The method of claim 1, wherein the second agent is administered at least 24 hours after administration of the PEGylated soluble PH20 hyaluronidase.

22. The method of claim 1, wherein administration of the PEGylated soluble PH20 hyaluronidase and the second agent results in a reduction in tumor size and/or tumor volume compared to tumor size and/or tumor volume before administration of the PEGylated soluble PH20 hyaluronidase and the second agent.

23. The method of claim 22, wherein administration of the PEGylated soluble PH20 hyaluronidase and the second agent results in a reduction in tumor size compared to tumor size before administration of the PEGylated soluble PH20 hyaluronidase and the second agent.

24. The method of claim 22, wherein administration of the PEGylated soluble PH20 hyaluronidase and the second agent results in a reduction in tumor volume compared to tumor volume before administration of the PEGylated soluble PH20 hyaluronidase and the second agent.

25. The method of claim 22, wherein administration of the PEGylated soluble PH20 hyaluronidase and the second agent results in a reduction in tumor size and tumor volume compared to tumor size and tumor volume before administration of the PEGylated soluble PH20 hyaluronidase and the second agent.

26. The method of claim 1, wherein:
the method comprises, prior to step a), obtaining a tumor sample from the subject.

27. The method of claim 1, wherein measurement is effected by immunohistochemistry.

28. The method of claim 1, wherein hyaluronan is expressed in at least 50% of the tumoral area of the tumor sample.

29. A method of treating a tumor in a subject having pancreatic cancer, comprising:
a) identifying, for treatment, the subject with a tumor of a type in which hyaluronan is expressed in at least 30% of the tumoral area in a tumor sample, wherein; the subject has pancreatic cancer; and the sample is a pancreatic tumor biopsy sample; and then
b) administering to the subject a PEGylated soluble human PH20 hyaluronidase, and administering a second agent that is an anti-cancer agent or treatment for treating the tumor in the subject, to thereby effect treatment.

30. The method of claim 29, wherein the second agent is a chemotherapeutic agent.

31. The method of claim 29, wherein hyaluronan is expressed in at least 50% of the tumoral area of the tumor sample.

* * * * *

UNITED STATES PATENT AND TRADEMARK OFFICE
CERTIFICATE OF CORRECTION

PATENT NO. : 10,328,130 B2  
APPLICATION NO. : 13/385528  
DATED : June 25, 2019  
INVENTOR(S) : Frost et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 181 days.

Signed and Sealed this  
Nineteenth Day of May, 2020

Andrei Iancu  
*Director of the United States Patent and Trademark Office*